United States Patent
Goldberg et al.

(10) Patent No.: US 10,655,102 B2
(45) Date of Patent: May 19, 2020

(54) IDENTIFICATION AND ISOLATION OF HUMAN CORNEAL ENDOTHELIAL CELLS (HCECS)

(71) Applicant: EMMETROPE OPHTHALMICS LLC, Key Biscayne, FL (US)

(72) Inventors: Jeffrey L. Goldberg, San Diego, CA (US); Noelia J. Kunzevitzky, La Jolla, CA (US)

(73) Assignee: Emmetrope Ophthalmics LLC, Menlo Park, CA (US)

( * ) Notice: Subject to any disclaimer, the term of this patent is extended or adjusted under 35 U.S.C. 154(b) by 888 days.

(21) Appl. No.: 14/888,875

(22) PCT Filed: May 2, 2014

(86) PCT No.: PCT/US2014/036616
§ 371 (c)(1),
(2) Date: Nov. 3, 2015

(87) PCT Pub. No.: WO2014/179716
PCT Pub. Date: Nov. 6, 2014

(65) Prior Publication Data
US 2016/0102290 A1  Apr. 14, 2016

Related U.S. Application Data

(60) Provisional application No. 61/819,146, filed on May 3, 2013.

(51) Int. Cl.
*C12N 5/079* (2010.01)
*G01N 33/50* (2006.01)

(52) U.S. Cl.
CPC ....... *C12N 5/0621* (2013.01); *G01N 33/5064* (2013.01)

(58) Field of Classification Search
CPC .......................... C12N 5/0621; G01N 33/5064
See application file for complete search history.

(56) References Cited

U.S. PATENT DOCUMENTS

2011/0236347 A1  9/2011  Baumert et al.
2012/0149598 A1*  6/2012  Inoue .................. C12N 5/0621
                                                        506/10

(Continued)

FOREIGN PATENT DOCUMENTS

EP  1130032 A1  9/2001
EP  3029140 A1  6/2016

(Continued)

OTHER PUBLICATIONS

Takács L. et al., "Stem Cells of the Adult Cornea: From Cytometric Markers to Therapeutic Applications", Cytometry Part A 75A(1):54-66 (2009).

(Continued)

*Primary Examiner* — Gailene Gabel
(74) *Attorney, Agent, or Firm* — Rodney J. Fuller; Booth Udall Fuller, PLC

(57) ABSTRACT

The present invention provides methods for the identification, isolation and/or enrichment of human corneal endothelial cells (HCECs). In some embodiments, the method comprises a positive selection process in which a cell population containing human corneal cells is contacted with a positive affinity reagent that selectively binds to HCECs relative to cells other than HCECs (e.g., corneal keratocytes, etc.) in the population and/or a negative selection process in which a cell population containing HCECs is contacted with a negative affinity reagent that selectively binds to cells other than HCECs in the population relative to HCECs. The present invention also provides reagents and kits for the (Continued)

identification, isolation and/or enrichment of HCECs as well as compositions that are enriched in HCECs.

14 Claims, 5 Drawing Sheets

Specification includes a Sequence Listing.

(56) References Cited

U.S. PATENT DOCUMENTS

| | | | | |
|---|---|---|---|---|
| 2014/0170751 | A1* | 6/2014 | Hayashi | C12N 5/0621 |
| | | | | 435/377 |
| 2014/0370007 | A1* | 12/2014 | McCabe | A61K 35/30 |
| | | | | 424/133.1 |

FOREIGN PATENT DOCUMENTS

| | | | |
|---|---|---|---|
| JP | 2007508015 A | 4/2007 |
| JP | 2016521130 A | 7/2016 |
| WO | 2005038015 A1 | 4/2005 |
| WO | 2011096593 A1 | 8/2011 |
| WO | 2013012087 A1 | 1/2013 |
| WO | 2013086236 A2 | 6/2013 |
| WO | 2014179716 A2 | 11/2014 |

OTHER PUBLICATIONS

Bartakova A. et al., "Novel Identity and Functional Markers for Human Corneal Endothelial Cells", Investigative Opthalmology & Visual Science, 57(6) 2749-2762 (2016).

Chen, Y., et al, "Identification of novel molecular markers through transcriptomic analysis in human fetal and adult corneal endothelial cells", Human Molecular Genetics, 22(7):1271-1279 (2013).

Yoshida, Y., et al., "Tight Junction Transmembrane Protein Claudin Subtype Expression and Distribution in Human Corneal and Conjunctival Epithelium", Investigative Ophthalmology & Visual Science, 50(5):2103-2108 (2009).

Smith, J.R., et al., "Short Communication: Expression and regulation of activated leukocyte cell adhesion molecule in human retinal vascular endothelial cells", Experimental Eye Research 104:89-93 (2012) 9 pages.

Harrison, T.A., et al., "Corneal endothelial cells possess an elaborate multipolar shape to maximize the basolateral to apical membrane area", Molecular Vision 22:31-39 (2016).

Hatou, S., et al., "Functional corneal endothelium derived from corneal stroma stem cells of neural crest origin by retinoic acid and Wnt/β-catenin signaling", Stem Cells Dev. 22(5):828-39 (2013).

Foets, B.J.J., et al., "In situ immunohistochemical analysis of cell adhesion molecules on human corneal endothelial cells", British Journal of Ophthalmology, 76:205-209 (1992).

Forest, F., et al., "Optimization of immunostaining on flat-mounted human corneas", Molecular Vision, 21:1345-1356 (2015).

Peh, G.S.L., et al., "Cultivation of Human Coneal Endothelial Cells Isolated from Paired Donor Corneas", PloS ONE 6 (12):1-10 (2011).

Peh, G.S.L., et al., "Optimization of Human Corneal Endothelial Cells for Culture: The Removal of Corneal Stromal Fibroblast Contamination Using Magnetic Cell Separation", International Journal of Biomaterials, vol. 2012, Article ID 601302, pp. 1-9, (2012).

Peh, G.S.L., et al., "Optimization of human corneal endothelial cell culture: density dependency of successful cultures in vitro", BMC Research Notes, 6:176, 9 pages (2013).

Extended European Search Report for application No. 14792047.4, dated Aug. 23, 2016, 7 pages.

Mehta, J. et al. "Identification of New markers of Human Corneal Endothelial Cells", ARVO 2013 Annual Meeting Abstracts, Program No. 2198.

Chen, K-H, et al., "Transplantation of Adult Human Corneal Endothelium Ex Vivo: A Morphologic Study", Cornea, 20(7):731-737 (2001).

Gottsch, J.D., et al., "Gene Expression in Donor Corneal Endothelium", Ophthalmic Molecular Genetics, vol. 121, 7 pages (2003).

Joyce, N.C., et al., "Potential of human umbilical cord blood mesenchymal stem cells to heal damaged corneal endothelium", Molecular Vision 2012, 18:547-564, (2012).

Harvey, S.A.K., et al., "Downstream Effects of ROCK Signaling in Cultured Human Corneal Stromal Cells: Microarray Analysis of Gene Expression", Investigative Ophthalmology & Visual Science, 45(7):2168-2176 (2004).

Dyrlund, T.F., et al., "Human Cornea Proteome: Identification and Quantitation of the Proteins of the Three Main Layers Including Epithelium, Stroma, and Endothelium", Journal of Proteome Research, 11:4231-4239 (2012).

Yamamizu, A., et al, "Identification of Corneal Endothelial Cell-Specific Cell Surface Markers", (Abstract No. P-081). vol. 9 supplement, p. 283 (2010).

Sundberg, M. et al., "CD marker expression profiles of human embryonic stem cells and their neural derivatives, determined using flow-cytometric analysis, reveal a novel CD marker for exclusion of pluripotent stem cells", Stem Cell Research, 2(2)113-124 (2009).

* cited by examiner

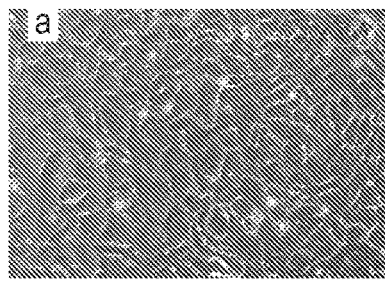 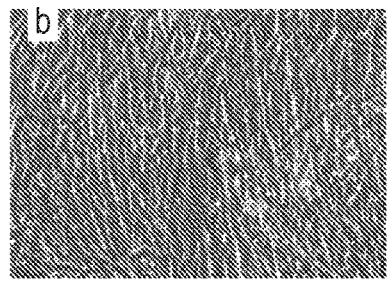 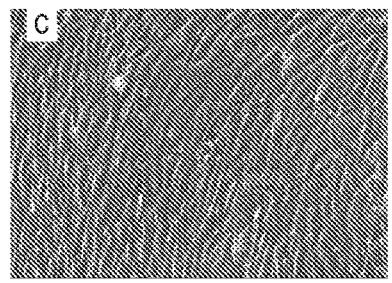
FIG. 1A  P2 HCEC CULTURE - "GOOD"
FIG. 1B  P3 HCEC CULTURE - "FIBROBLASTIC"
FIG. 1C  P3 CORNEAL KERATOCYTE CULTURE
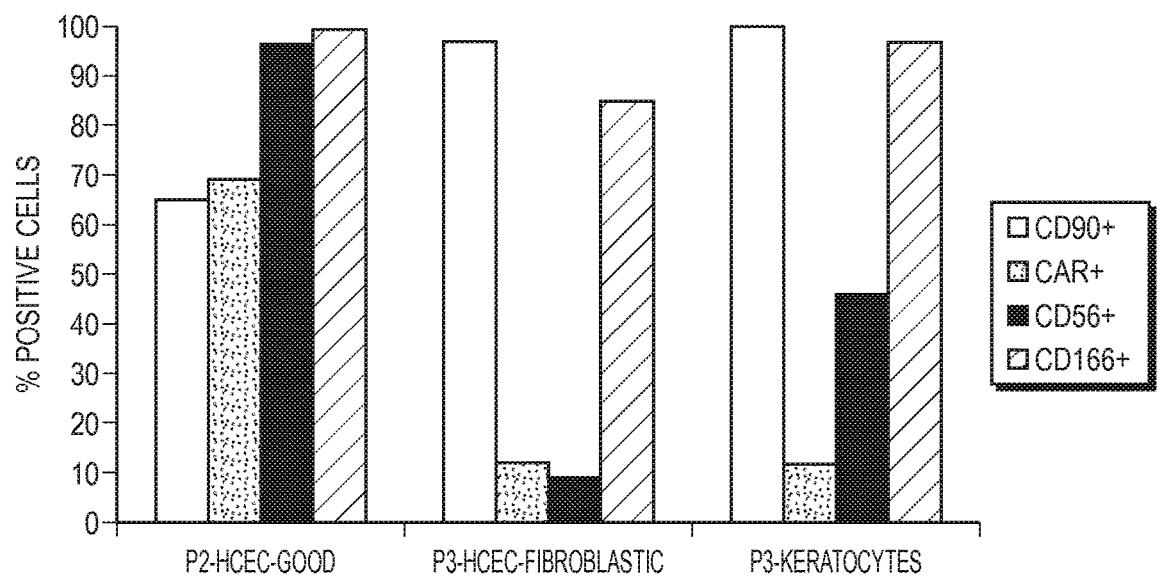
FIG. 2

IDENTIFICATION AND ISOLATION OF HUMAN CORNEAL ENDOTHELIAL CELLS (HCECS)

STATEMENT OF RELATED APPLICATION

This application claims the benefit of U.S. Application Ser. No. 61/819,146, entitled "METHOD FOR IDENTIFYING AND ISOLATING HUMAN CORNEAL ENDOTHELIAL CELLS (HCECs)," filed May 3, 2013, the entire disclosure of which is hereby incorporated by reference.

SEQUENCE LISTING

The instant application contains a Sequence Listing which has been filed electronically in ASCII format and is hereby incorporated by reference in its entirety. Said ASCII copy, created on Aug. 13, 2018, is named 4071-7 Sequence Listing.txt and is 821,867 bytes in size.

BACKGROUND OF THE INVENTION

When the innermost layer of the cornea, the endothelium, is damaged, for example from trauma (e.g., from cataract surgery), disease or dystrophy, the cornea swells with fluid (edema) and loses its optical clarity. Patients consequently suffer from vision loss and pain, and their only option to treat advanced disease is with corneal transplant surgery (also known as penetrating keratoplasty, PK) or Descemet's stripping endothelial keratoplasty (DSAEK), both technically difficult procedures that are very invasive to the patient and have significant limitations, such as the number of donor corneas available.

Recent studies have proposed the use of human corneal endothelial cells (HCECs) obtained from cadaveric donors to replace the damaged cells. See, e.g., Joyce and Zhu, *Cornea.* 2004 November; 23(8 Suppl):S8-S19; Engelmann, et al., *Exper. Eye Res.*, vol. 78, no. 3, pp. 573-578, 2004. A potential advantage to such an approach could be the expansion of HCECs ex vivo before implantation into patients, thereby overcoming the limited tissue availability. HCECs can be expanded in defined tissue culture media for at least 5 passages, greatly expanding the number of cells derived from a single donor.

One of the main problems with such a technique is that the lack of defined surface markers specific for HCECs makes it difficult to confirm the identity of HCECs after several passages, or to select HCECs away from contaminating cells, or to identify the subset of HCECs that are likely to have the highest clinical efficacy from among the full population of HCECs, as current identification criteria are limited to cell morphology and the expression of functional genes, such as ATP1A1 (see, e.g., Kaye and Tice. *Invest Ophthalmol.* 1966; 522-32: Leuenberger and Novikoff, *J Cell Biol.* 1974: 60721-731; McCartney et al. *Curr Eye* 1987; 61479-1486) or the tight junction marker zonula occludens-1 (ZO-1) (see, e.g., Petroll et al., *Curr Eye Res.* 1999 January; 18(1):10-9), neither of which are specific to HCECs. It is also difficult to isolate HCECs from contaminant fibroblasts in culture, from neighboring cells in whole corneas, or from residual corneas from DSAEK.

In this regard, the current isolation method for obtaining HCECs from intact corneas comprises a peel-off step, where the endothelium and its basement membrane (Descemet's membrane) are peeled off the stroma and collected. See, e.g., Ko-Hua Chen et al., "Transplantation of Adult Human Corneal Endothelium Ex Vivo: A Morphologic Study," *Cornea* 20(7): 731-737, 2001. The tissue collected thus contains HCECs, but it may also contain corneal keratocytes (specialized fibroblasts residing the stroma). Corneal keratocytes (also referred to herein simply as "keratocytes") are undesirable contaminants in the HCECs culture, as they grow faster than the latter cells and they can take over the culture dish, thus making the final product essentially useless. In addition to residual stromal tissue, keratocytes may also arise from human endothelial cells which transform spontaneously into other types of cells such as keratocytes (see, e.g., G S. L. Peh et al., "Optimization of Human Corneal Endothelial Cells for Culture: The Removal of Corneal Stromal Fibroblast Contamination Using Magnetic Cell Separation," International Journal of Biomaterials, Volume 2012 (2012), Article ID 601302, 8 pages.)

SUMMARY OF THE INVENTION

Some aspects of the invention are directed to methods for the identification, enrichment and/or isolation of human corneal endothelial cells (HCECs).

In some embodiments, the method comprises a positive selection process in which a cell population containing human corneal cells is contacted with a positive affinity reagent that selectively binds to HCECs relative to cells other than HCECs. The cells to which the positive affinity reagent is bound are then selected, with the result being that selected cells are enriched with HCECs. In some embodiments, two or more differing positive affinity reagents which bind to HCECs but which do not bind to cells other than HCECs are employed.

As defined herein "cells other than human corneal endothelial cells" (or "cells other than HCECs") include corneal keratocytes as well as HCECs of lower utility (e.g., HCECs that have undergone fibroblastic or mesenchymal transformation, etc.).

In other embodiments, the method comprises a negative selection process in which a cell population containing human corneal cells is contacted with a negative affinity reagent that selectively binds to cells other than HCECs (e.g., corneal keratocytes, etc.) relative to HCECs. The cells to which the negative affinity reagent is bound are then removed, with the result being that the cells that are not removed are enriched with HCECs. In some embodiments, two or more differing negative affinity reagents which bind to cells other than HCECs (e.g., corneal keratocytes, etc.) but which do not bind to HCECs are employed.

In some embodiments, the method comprises both (a) positive selection using one or more affinity reagents agents and (b) negative selection using one or more negative affinity reagents.

Other aspects of the invention are directed to affinity reagents and kits useful for the identification, enrichment and/or isolation of HCECs.

Still other aspects of the invention are direct to isolated and/or enriched cell populations that contain HCECs. In some embodiments, such enriched cell populations may contain affinity reagents for the purification of HCECs.

Further aspects of the invention a set forth in the following paragraphs:

Aspect 1. A method of forming a composition enriched with human corneal endothelial cells comprising: (a) contacting a cell population containing human corneal cells with a first positive affinity reagent that selectively binds to human corneal endothelial cells relative to cells other than human corneal endothelial cells and (b) selecting cells to which the first positive affinity reagent is bound.

Aspect 2. The method of aspect 1, wherein the first positive affinity reagent selectively binds to human corneal endothelial cells relative to corneal keratocytes, human corneal endothelial cells of lower utility, or both.

Aspect 3. The method of aspect 1, wherein the first positive affinity reagent selectively binds to a corneal protein selected from protein products of genes X1 through X26 of Table 2, and may comprise, for example, an antibody or aptamer that binds to a corneal protein selected from protein products of genes X1 through X26 of Table 2, including an antibody or aptamer that binds to one or more proteins selected from SEQ ID NO (1) through SEQ ID NO (58) of Table 2.

Aspect 4. The method of aspect 1, wherein the first positive affinity reagent comprises an antibody or aptamer that binds to a protein product of gene X5 of Table 2, an antibody or aptamer that binds to a protein product of gene X15 of Table 2, or an antibody or aptamer that binds to a protein product of X25 of Table 2.

Aspect 5. The method of aspect 1, wherein the first positive affinity reagent comprises (a) an antibody or aptamer that binds to SEQ ID NO (8), (b) an antibody or aptamer that binds to one or more of SEQ ID NO (27), SEQ ID NO (28), SEQ ID NO (29), SEQ ID NO (30) or SEQ ID NO (31), or (c) an antibody or aptamer that binds to one or more of SEQ ID NO (53), SEQ ID NO (54), SEQ ID NO (55), SEQ ID NO (56) or SEQ ID NO (57).

Aspect 6. The method of any of aspects 1-5, wherein the first positive affinity reagent comprises an antibody or aptamer that is coupled to a solid matrix.

Aspect 7. The method of any of aspects 1-6, wherein the first positive affinity reagent comprises an antibody or aptamer that is coupled to a label.

Aspect 8. The method of aspect 7, wherein the label is selected from a magnetic label, a hapten (e.g., biotin) and a fluorescent label.

Aspect 9. The method of any of aspects 1-8, further comprising (a) contacting said cell population containing human corneal cells with a second positive affinity reagent that selectively binds to human corneal endothelial cells relative to cells other than human corneal endothelial cells and (b) selecting cells to which the second positive affinity reagent is bound, wherein the second positive affinity reagent differs from the first positive affinity reagent.

Aspect 10. The method of aspect 9, wherein the second positive affinity reagent selectively binds to a corneal protein selected from protein products of genes X1 through X26 of Table 2, and may comprise, for example, an antibody or aptamer that binds to a corneal protein selected from protein products of genes X1 through X26 of Table 2, including an antibody or aptamer that binds to one or more proteins selected from SEQ ID NO (1) through SEQ ID NO (58) of Table 2.

Aspect 11. The method of aspect 9, wherein the second positive affinity reagent comprises an antibody or aptamer that binds to a protein product of gene X5 of Table 2, an antibody or aptamer that binds to a protein product of gene X15 of Table 2, or an antibody or aptamer that binds to a protein product of X25 of Table 2.

Aspect 12. The method of aspect 9, wherein the second positive affinity reagent comprises (a) an antibody or aptamer that binds to SEQ ID NO (8), (b) an antibody or aptamer that binds to one or more of SEQ ID NO (27), SEQ ID NO (28), SEQ ID NO (29), SEQ ID NO (30) or SEQ ID NO (31), or (c) an antibody or aptamer that binds to one or more of SEQ ID NO (53), SEQ ID NO (54), SEQ ID NO (55), SEQ ID NO (56) or SEQ ID NO (57).

Aspect 13. The method of any of aspects 9-12, wherein the second positive affinity reagent comprises an antibody or aptamer that is coupled to a solid matrix or a label.

Aspect 14. The method of any of aspects 1-13, further comprising (a) contacting said cell population containing human corneal cells with a first negative affinity reagent that selectively binds to cells other than human corneal endothelial cells relative to human corneal endothelial cells and (b) removing the cells to which the first negative affinity reagent is bound.

Aspect 15. The method of aspect 14, wherein the first negative affinity reagent selectively binds to corneal keratocytes, human corneal endothelial cells of lower utility, or both, relative to human corneal endothelial cells.

Aspect 16. The method of aspect 14, wherein the first negative affinity reagent selectively binds to a corneal protein selected from protein products of genes Y1 through Y23 of Table 2, and may comprise, for example, an antibody or aptamer that binds to a corneal protein selected from protein products of genes Y1 through Y23 of Table 2, including an antibody or aptamer that binds to one or more proteins selected from SEQ ID NO (59) through SEQ ID NO (96) of Table 2, or wherein the first negative affinity reagent selectively binds to a corneal protein selected from protein products of genes Z1 through Z8 of Table 2, and may comprise, for example, an antibody or aptamer that binds to a corneal protein selected from protein products of genes Z1 through Z8 of Table 2, including an antibody or aptamer that binds to one or more proteins selected from SEQ ID NO (97) through SEQ ID NO (109) of Table 2.

Aspect 17. The method of aspect 14, wherein the first negative affinity reagent comprises an antibody or aptamer that binds to a protein product of gene Y6 of Table 2.

Aspect 18. The method of aspect 14, wherein the first negative affinity reagent comprises an antibody or aptamer that binds to one or more of SEQ ID NO (66), SEQ ID NO (67) or SEQ ID NO (68).

Aspect 19. The method of any of aspects 14-18, wherein the first negative affinity reagent comprises an antibody or aptamer that is coupled to a solid matrix or a label.

Aspect 20. A composition enriched with human corneal endothelial cells that is made by the method of any of aspects 1-19.

Aspect 21. A kit comprising (a) a positive affinity reagent that selectively binds to human corneal endothelial cells relative to cells other than human corneal endothelial cells and (b) a negative affinity reagent that selectively binds to cells other than human corneal endothelial cells relative to human corneal endothelial cells.

Aspect 22. The kit of aspect 21, wherein the positive affinity reagent selectively binds to a corneal protein selected from protein products of genes X1 through X26 of Table 2, and may comprise, for example, an antibody or aptamer that binds to a corneal protein selected from protein products of genes X1 through X26 of Table 2, including an antibody or aptamer that binds to one or more proteins selected from SEQ ID NO (1) through SEQ ID NO (58) of Table 2.

Aspect 23. The kit of aspect 21, wherein the first positive affinity reagent comprises an antibody or aptamer that binds to a protein product of gene X5 of Table 2, an antibody or aptamer that binds to a protein product of gene X15 of Table 2, or an antibody or aptamer that binds to a protein product of X25 of Table 2.

Aspect 24. The kit of aspect 21, wherein the first positive affinity reagent comprises (a) an antibody or aptamer that binds to SEQ ID NO (8), (b) an antibody or aptamer that binds to one or more of SEQ ID NO (27), SEQ ID NO (28), SEQ ID NO (29), SEQ ID NO (30) or SEQ ID NO (31), or (c) an antibody or aptamer that binds to one or more of SEQ ID NO (53), SEQ ID NO (54), SEQ ID NO (55), SEQ ID NO (56) or SEQ ID NO (57).

Aspect 25. The kit of any of aspects 21-24, wherein the positive affinity reagent comprises an antibody or aptamer that is coupled to a solid matrix or a label.

Aspect 26. The kit of any of aspects 21-25, wherein the negative affinity reagent selectively binds to a corneal protein selected from protein products of genes Y1 through Y23 of Table 2, and may comprise, for example, an antibody or aptamer that binds to a corneal protein selected from protein products of genes Y1 through Y23 of Table 2, including an antibody or aptamer that binds to one or more proteins selected from SEQ ID NO (59) through SEQ ID NO (96) of Table 2, or wherein the negative affinity reagent selectively binds to a corneal protein selected from protein products of genes Z1 through Z8 of Table 2, and may comprise, for example, an antibody or aptamer that binds to a corneal protein selected from protein products of genes Z1 through Z8 of Table 2, including an antibody or aptamer that binds to one or more proteins selected from SEQ ID NO (97) through SEQ ID NO (109) of Table 2.

Aspect 27. The kit of any of aspects 21-25, wherein the negative affinity reagent comprises an antibody or aptamer that binds to a protein product of gene Y6 of Table 2.

Aspect 28. The kit of any of aspects 21-25, wherein the first negative affinity reagent comprises an antibody or aptamer that binds to one or more of SEQ ID NO (66), SEQ ID NO (67) or SEQ ID NO (68).

Aspect 29. The kit of any of aspects 21-28, wherein the negative affinity reagent comprises an antibody or aptamer that is coupled to a solid matrix or a label.

Aspect 30. An affinity reagent selected from (a) a solid matrix or a label coupled to an antibody or aptamer that binds to a corneal protein selected from protein products of genes X1 through X26 of Table 2, including an antibody or aptamer that binds to one or more proteins selected from SEQ ID NO (1) through SEQ ID NO (58) of Table 2, and (b) a solid matrix or a label coupled to an antibody or aptamer that binds to a corneal protein selected from protein products of genes Y1 through Y23 of Table 2, including an antibody or aptamer that binds to one or more proteins selected from SEQ ID NO (59) through SEQ ID NO (96) of Table 2, and protein products of genes Z1 through Z8 of Table 2, including an antibody or aptamer that binds to one or more proteins selected from SEQ ID NO (97) through SEQ ID NO (109) of Table 2.

Aspect 31. A composition enriched with human corneal endothelial cells comprising: (a) human corneal cells and (b) a first positive affinity reagent that selectively binds to human corneal endothelial cells relative to cells other than human corneal endothelial cells.

Aspect 32. The composition of aspect 31, comprising human corneal endothelial cells to which the first positive affinity reagent is bound.

Aspect 33. The composition of any of aspects 31-32, wherein the first positive affinity reagent selectively binds to human corneal endothelial cells relative to corneal keratocytes, human corneal endothelial cells of lower utility, or both.

Aspect 34. The composition of any of aspects 31-33, wherein the first positive affinity reagent selectively binds to a corneal protein selected from protein products of genes X1 through X26 of Table 2, and may comprise, for example, an antibody or aptamer that binds to a corneal protein selected from protein products of genes X1 through X26 of Table 2, including an antibody or aptamer that binds to one or more proteins selected from SEQ ID NO (1) through SEQ ID NO (58) of Table 2.

Aspect 35. The composition of any of aspects 31-33, wherein the first positive affinity reagent comprises an antibody or aptamer that binds to a protein product of gene X5 of Table 2, an antibody or aptamer that binds to a protein product of gene X15 of Table 2, or an antibody or aptamer that binds to a protein product of X25 of Table 2.

Aspect 36. The composition of any of aspects 31-33, wherein the first positive affinity reagent comprises (a) an antibody or aptamer that binds to SEQ ID NO (8), (b) an antibody or aptamer that binds to one or more of SEQ ID NO (27), SEQ ID NO (28), SEQ ID NO (29), SEQ ID NO (30) or SEQ ID NO (31), or (c) an antibody or aptamer that binds to one or more of SEQ ID NO (53), SEQ ID NO (54), SEQ ID NO (55), SEQ ID NO (56) or SEQ ID NO (57).

Aspect 37. The composition of any of aspects 31-36, wherein the first positive affinity reagent comprises an antibody or aptamer that is coupled to a label.

Aspect 38. The composition of aspect 37, wherein the label is selected from a magnetic label, a hapten (e.g., biotin) and a fluorescent label.

Aspect 39. The composition of any of aspects 31-38, further comprising a second positive affinity reagent that selectively binds to human corneal endothelial cells relative to cells other than human corneal endothelial cells, wherein the second positive affinity reagent differs from the first positive affinity reagent.

Aspect 40. The composition of aspect 39, comprising human corneal endothelial cells to which the second positive affinity reagent is bound.

Aspect 41. The composition of any of aspects 39-40, wherein the second positive affinity reagent selectively binds to a corneal protein selected from protein products of genes X1 through X26 of Table 2, and may comprise, for example, an antibody or aptamer that binds to a corneal protein selected from protein products of genes X1 through X26 of Table 2, including an antibody or aptamer that binds to one or more proteins selected from SEQ ID NO (1) through SEQ ID NO (58) of Table 2.

Aspect 42. The composition of any of aspects 39-40, wherein the second positive affinity reagent comprises an antibody or aptamer that binds to a protein product of gene X5 of Table 2, an antibody or aptamer that binds to a protein product of gene X15 of Table 2, or an antibody or aptamer that binds to a protein product of X25 of Table 2.

Aspect 43. The composition of any of aspects 39-40, wherein the second positive affinity reagent comprises (a) an antibody or aptamer that binds to SEQ ID NO (8), (b) an antibody or aptamer that binds to one or more of SEQ ID NO (27), SEQ ID NO (28), SEQ ID NO (29), SEQ ID NO (30) or SEQ ID NO (31), or (c) an antibody or aptamer that binds to one or more of SEQ ID NO (53), SEQ ID NO (54), SEQ ID NO (55), SEQ ID NO (56) or SEQ ID NO (57).

Aspect 44. The composition of any of aspects 39-43, wherein the second positive affinity reagent comprises a label.

Aspect 45. The composition of any of aspects 31-44, comprising a measurable amount of one or more negative affinity reagents that selectively binds to cells other than human corneal endothelial cells relative to human corneal endothelial cells.

Aspect 46. The composition of aspect 45, wherein the one or more negative affinity reagents selectively binds to corneal keratocytes, human corneal endothelial cells of lower utility, or both, relative to human corneal endothelial cells.

Aspect 47. The composition of any of aspects 45-46, wherein the one or more negative affinity reagents selectively bind to a corneal protein selected from protein products of genes Y1 through Y23 of Table 2, and may comprise, for example, one or more antibodies that bind to one or more corneal proteins selected from protein products of genes Y1 through Y23 of Table 2, including one or more antibodies or aptamers that bind to one or more proteins selected from SEQ ID NO (59) through SEQ ID NO (96) of Table 2, or the one or more negative affinity reagents selectively bind to a corneal protein selected from protein products of genes Z1 through Z8 of Table 2, and may comprise, for example, one or more antibodies or aptamers that bind to one or more corneal proteins selected from protein products of genes Z1 through Z8 of Table 2, including one or more antibodies or aptamers that bind to one or more proteins selected from SEQ ID NO (97) through SEQ ID NO (109) of Table 2.

Aspect 48. The composition of any of aspects 45-46, wherein the one or more negative affinity reagents comprise an antibody or aptamer that binds to a protein product of gene Y6 of Table 2.

Aspect 49. The composition of any of aspects 45-46, wherein the one or more negative affinity reagents comprise an antibody or aptamer that binds to one or more of SEQ ID NO (66), SEQ ID NO (67) or SEQ ID NO (68).

Aspect 50. The composition of any of aspects 45-49, wherein the one or more negative affinity reagents comprise an antibody or aptamer that is coupled to a label.

These and various other aspects and embodiments and as well as various advantages of the present invention will become immediately apparent to those of ordinary skill in the art upon review of the Detailed Description and appended claims to follow.

BRIEF DESCRIPTION OF THE DRAWINGS

FIGS. 1A-1C are bright field micrographs of HCECs and keratocytes in culture, with FIG. 1A illustrating a HCEC culture having preserved a typical cobblestone morphology (P2-HCEC-Good), FIG. 1B illustrating a HCEC culture after having become fibroblastic (P3-HCEC-Fibroblastic), and FIG. 1C illustrating a human corneal keratocyte culture (P2-HCEC-Keratocytes).

FIG. 2 illustrates in bar graph form expression of four surface markers in different corneal cell populations analyzed by flow cytometry.

DETAILED DESCRIPTION

Figure 3A:
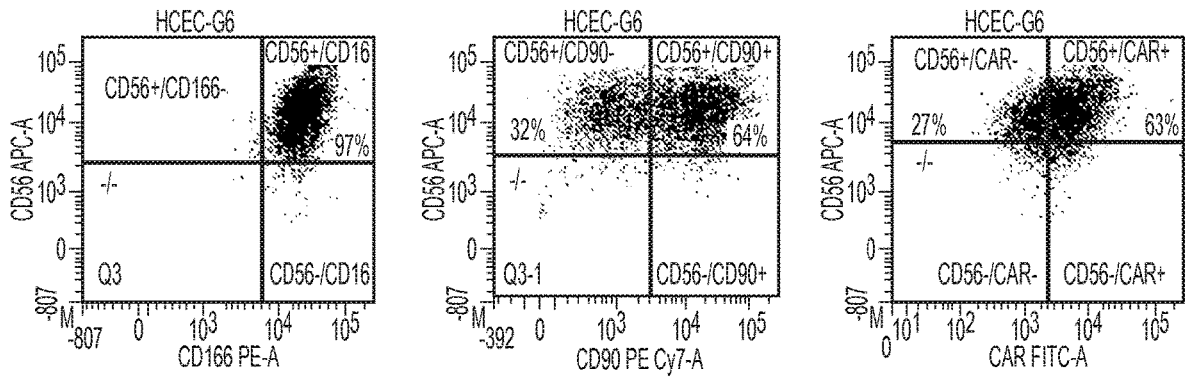
FIGS. 3A-3C are dual-color fluorescence histograms of HCECs and keratocytes. These dot plots show the differential expression of two surface markers (CD56:CD166, CD56:CD90 and CD56:CAR) in each cell population, with FIG. 3A corresponding to the P2-HCEC-Good culture shown in FIG. 1A, FIG. 3B corresponding to the P3-HCEC-Fibroblastic culture shown in FIG. 1B, and FIG. 3C corresponding to the P2-HCEC-Keratocytes culture shown in FIG. 1C.

A more complete understanding of the present invention is available by reference to the following detailed description of numerous aspects and embodiments of the invention. The detailed description of the invention which follows is intended to illustrate but not limit the invention.

As noted above, in some aspects, the present disclosure pertains to positive selection processes in which cell populations containing human corneal cells are contacted with one or more positive affinity reagents that selectively bind to HCECs relative to cells other than HCECs (e.g., corneal keratocytes, etc.), including positive affinity reagents that selectively bind to HCECs that are likely to have a higher clinical efficacy relative to the general HCEC population In other aspects, the present disclosure pertains to negative selection processes in which cell populations containing human corneal cells are contacted with one or more negative affinity reagents that bind selectively bind to cells other than HCECs (e.g., corneal keratocytes, etc.) relative to HCECs.

These negative and positive selection methods may be used independently or in combination with one another, for example, to identifying HCECs, to isolate HCECs and/or to enrich cell populations with HCECs, among other uses.

Cell populations suitable for HCEC enrichment or isolation include those obtained from intact or residual human corneas, which may come, for instance, from embryonic, fetal, pediatric or adult tissue. For example, intact corneas may be subjected to a peel-off step in which the endothelium and its basement membrane (Descemet's membrane) are peeled off the stroma and collected. See Ko-Hua Chen et al., "Transplantation of Adult Human Corneal Endothelium Ex Vivo: A Morphologic Study," *Cornea* 20(7): 731-737, 2001. In other embodiments, cell populations may be obtained from residual corneas (e.g., eye tissue remaining after a corneal button has been used for DSAEK).

Tissue from intact and residual corneas may be separated into individual cells by processes such as enzymatic and/or mechanical dissociation. At this step, cells are incubated for a period of time at room temperature or at 37° C. with a single enzyme or a combination of enzymes including some of the following: collagenase, papain, dispase, elastase, trypsin/EDTA, and/or DNAse. Later the tissues are mechanically dissociated using a conventional pipette or a glass pipette to obtain individual cells or cell clumps than can be then expanded in culture. See, e.g., Li W. et al., *Invest Ophthalmol Vis Sci* 2007; 48: 614; Ishino Y. et al., *Invest Ophthalmol Vis Sci* 2004; 45: 800; Chen K. H. et al., *Cornea* 2001; 20: 731.

The medium in which the cells may be suspended will be any medium which maintains the viability of HCECs. Various media are commercially available and may be used including Minimal Essential Medium (MEM), Dulbecco's Modified Eagle Medium (DMEM), Opti-MEMO, Media 199 or M199, Dulbecco's Modified Eagle Medium with Nutrient Mixture F-12 (DMEM/F-12), F99 Ham's F12, SHEM Ham's F12, EGM-2 endothelial growth medium frequently supplemented with serum of human or animal origin, BSA, HSA, growth factors, antioxidants, antibiotics, antimicotic agents, hormones, amino acids, and peptides. Specific examples of media are shown in Table 1 to follow.

TABLE 1

| Base Medium | Serum | Growth Factors & Supplements |
|---|---|---|
| [M1] DMEM | 10% | 2 ng/ml bFGF<br>50 U/ml penicillin<br>50 µg/ml streptomycin |
| [M2] Opti-MEM-I | 8% | 20 ng/ml NGF<br>5 ng/ml EGF<br>20 µg/ml ascorbic acid<br>200 mg/L calcium chloride<br>100 µg/ml pituitary extract<br>50 µg/ml gentamicin<br>1x antibiotic/antimycotic<br>0.08% chondroitin sulphate |
| [M3] SHEM Ham's F12 & DMEM (1:1 ratio) | 5% | 0.5% DMSO<br>2 ng/ml EGF<br>5 µg/ml insulin<br>5 µg/ml transferrin<br>5 ng/ml selenium<br>0.5 µg/ml hydrocortisone<br>1 nM cholera toxin<br>50 µg/ml gentamicin<br>1.25 µg/ml amphotericin B |
| [M4] F99 Ham's F 12 & M100 (1:1 ratio) | 5% | 20 µg/ml ascorbic acid<br>20 µg/ml bovine insulin<br>2.5 µg/mol transferrin<br>0.6 ng/ml sodium selentite<br>10 ng/ml bFGF |

Cell cultures from intact and residual corneas contain unwanted contaminant cells which arise from residual non-endothelial tissue (e.g., stroma, epithelium, etc.) that may be present in the sample. In a culture of HCECs, HCECs that are of low cell transplant utility compared to other HCECs of high cell transplant utility may also be considered, in some fashion, "contaminants".

Cell populations suitable for HCEC enrichment or isolation also include HCEC cultures in which contaminant cells have out-multiplied HCECs or in which HCECs have transformed spontaneously into other types of cells (e.g., keratocytes, etc.). As previously noted, contaminant cells such as keratocytes are particularly undesirable where it is desired to expand an HCEC culture ex vivo, because such cells grow faster than HCECs and can thus take over a cell culture.

Consequently, various aspects of the invention pertain to methods, reagents and kits for separation of HCECs from other cells, particularly, keratocytes and/or HCECs of lower utility. The HCECs are separated from mixtures of cells by techniques that select cells having particular characteristics.

Human corneal endothelial cells may identified or selected (a) through positive cell markers, which are cell markers that are found on the surfaces of HCECs but which are not found on the surfaces of contaminant cells which may be intermixed with HCECs (e.g., positive selection), (b) through negative cell markers, which are cell markers that are found on surfaces of contaminant cells that are intermixed with HCECs and but which are not found on the surfaces of HCECs (e.g., negative selection), and through a combination of positive and negative cell markers.

For example, in the case where whole human corneas are used as a source of endothelial cells, positive cell markers may be selected from corneal proteins which are found in the endothelium (which is formed from HCECs) but which are not found in other corneal tissue (i.e., the stroma and/or the epithelium). Conversely, negative cell markers may be selected from corneal proteins which are found in corneal tissue other than endothelium tissue (i.e., the stroma and/or the epithelium) but which are not found in corneal endothelium.

As another example, in the case where the source of endothelial cells is an endothelium and basement membrane that have been separated from the stroma and epithelium of an intact cornea, positive cell markers may be selected from corneal cell proteins which are found in the endothelium but which are not found in the stroma, while negative cell markers may be selected from corneal cell proteins which are found in the stroma but which are not found in corneal endothelium.

Corneal proteins which may be useful as cell markers in conjunction with the present invention include the suitable proteins selected from those presented in the Table 2 set forth in Appendix A.

Positive cell markers include suitable corneal proteins selected from protein products of genes X1-X26 in Table 2 (e.g., SEQ ID NO (1) through SEQ ID NO (58)) which are present in the corneal endothelium but are not present in the stroma or the epithelium.

Negative cell markers include (a) suitable corneal proteins selected from protein products of genes Y1-Y23 in Table 2 (e.g., SEQ ID NO (59) through SEQ ID NO (96)), which are present in the stroma and in epithelium but are not present in the endothelium and (b) suitable corneal proteins selected from protein products of genes Z1-Z8 in Table 2 (e.g., SEQ ID NO (97) through SEQ ID NO (109)), which are present in the stroma but are not present in the corneal endothelium (or epithelium).

As previously noted, in some aspects, the present disclosure pertains to (a) positive selection processes in which cell populations containing human corneal cells are contacted with one, two, three, four or more positive affinity reagents that selectively bind to HCECs relative to cells other than HCECs (e.g., corneal keratocytes, etc.), (b) negative selection processes in which cell populations containing human corneal cells are contacted with one, two, three, four or more negative affinity reagents that selectively bind to cells other than HCECs (e.g., corneal keratocytes, etc.) relative to HCECs, and (c) combinations of (a) and (b).

For this purpose, affinity reagents are employed which preferentially bind to various corneal proteins. Positive affinity reagents are those that preferentially bind to positive cell markers associated with HCECs while negative affinity reagents are those that preferably bind to negative cell markers associated with contaminant cells other than HCECs.

Various positive cell markers are described above and include corneal proteins which are found in the endothelium (which is formed from HCECs) but which are not found in other corneal tissue (i.e., the stroma and/or the epithelium). Various negative cell markers are also described above and include corneal proteins which are found in corneal tissue other than endothelium (i.e., the stroma and/or the epithelium) but which are not found in corneal endothelium.

Those skilled in the art will recognize that suitable negative and positive affinity reagents can be employed in any order and/or in any combination.

Affinity reagents suitable for use in the present disclosure may comprise any species which selectively binds to a given surface marker, including positive affinity reagents which selectively bind to positive cell markers and negative affinity reagents which selectively bind to negative cell markers.

Especially useful affinity reagents for the practice of the invention are antibodies (also referred to herein as "affinity antibodies"), nucleic acid aptamers and other engineered forms of protein scaffolds. Antibodies include whole antibodies and antibody fragments, e.g. Fab, F(ab')$_2$, light or heavy chain fragments, etc.

Affinity antibodies selected for use will have a low level of non-specific interactions.

Affinity antibodies may be polyclonal or monoclonal and, where not commercially available, may be readily produced by techniques known to those skilled in the art.

For instance, affinity antibodies to a given corneal protein may be obtained by immunizing a xenogeneic immunocompetent mammalian host (including murine, rodentia, lagomorpha, ovine, porcine, bovine, etc.) with the corneal protein of interest. Immunizations are performed in accordance with conventional techniques, where the corneal proteins may be injected subcutaneously, intramuscularly, intraperitoneally, intravascularly, etc., over a course of one or more injections. After completion of the immunization schedule, the antiserum may be harvested in accordance with conventional methods to provide polygonal antisera specific for the corneal protein of interest. Lymphocytes may also be harvested from the appropriate lymphoid tissue, e.g. spleen, draining lymph node, etc., and fused with an appropriate fusion partner, for example, a myeloma line, producing a hybridoma secreting a specific monoclonal antibody. Screening clones of hybridomas for the antigenic specificity of interest is performed in accordance with conventional methods.

In numerous embodiments, affinity antibodies are coupled to a suitable substrate, for example, a label or a solid matrix. Labels include magnetic labels such as magnetic beads or micro or nanoparticles including superparamagnetic nanoparticles, which allow for ease of separation. Labels also include biotin, which binds with high affinity to avidin or streptavidin. Labels further include fluorochromes, which can be used with flow cytometry, e.g., fluorescence activated cell sorting (FACS), or the like, to allow for ease of separation of a particular cell type. Fluorescence activated cell sorters have varying degrees of sophistication, such as multiple color channels, low angle and obtuse light scattering detecting channels, impedance channels, etc. Fluorochromes include phycobiliproteins, e.g., phycoerythrin and allophycocyanins, fluorescein and Texas red, cy7 and cy5, among others. Multiple antibodies each with an affinity to a particular corneal protein may each be labeled with a different fluorochrome, to permit independent sorting (multi-color analyses) for each associated cell protein.

Cell selection may also be achieved by "panning" with an affinity antibody attached to a solid matrix, e.g. a plate, an immobilized bead, and so forth. For example, an affinity antibody that has specificity for a particular corneal protein may be bound to a solid matrix and corneal cells displaying that particular corneal protein can be captured by the immobilized antibody while the other cells remain in suspension and can be removed.

Any sorting technique may be employed which is not unduly detrimental to the viability of the selected cells. Combinations of the above techniques may be used.

The precise method for coupling an antibody to a given substrate (e.g., a label, solid matrix, etc.) is not critical to the practice of the present disclosure, and a number of alternatives are known in the art. For example, affinity antibodies may directly or indirectly be coupled to a substrate. Direct coupling to a substrate can be achieved by use of various chemical linking groups, as known in the art. For example, an antibody can be coupled to a substrate through side chain amino or sulfhydryl groups and heterofunctional cross-linking reagents. Many heterofunctional compounds are available for linking to various entities. Specific examples include 3-(2-pyridyldithio)propionic acid N-hydroxysuccinimide ester (SPDP) or 4-(N-maleimidomethyl)-cyclohexane-1-carboxylic acid N-hydroxysuccinimide ester (SMCC), which can react with a reactive sulfhydryl group on the antibody and a reactive amino group on the substrate.

Alternatively, affinity antibodies can be indirectly coupled to a substrate via a hapten or a secondary antibody. For instance, the antibody may be directly conjugated to a hapten, and hapten-specific binding species may be conjugated to the substrate. Suitable haptens include digoxin, digoxigenin, FITC, dinitrophenyl, nitrophenyl, avidin, streptavidin, biotin, etc. For example, an antibody may be coupled to one member of a high affinity binding system (e.g., biotin) and another member of the high affinity binding system (e.g., avidin) attached to a substrate. Methods for conjugation of a hapten to a protein are known in the art, and kits for such conjugations are commercially available. The secondary antibody may be directly or indirectly bound to the substrate.

During cell separation, coupled antibodies may be combined with a suspension of cells and incubated for a period of time sufficient for the antibodies to bind to proteins on the cells. The amount of antibody necessary to bind a particular cell subset may be empirically determined by performing a test separation and analysis. The cells and antibodies are incubated for a period of time sufficient for binding to occur.

The medium in which the cells are separated will be any medium which maintains the viability of the cells. Various media are commercially available and include those listed above.

Coupled affinity antibodies include coupled positive affinity antibodies specific for the corneal proteins which are present on human corneal endothelial cells and which are not present on contaminant cells such as stromal and/or epithelial cells (for positive selection) and coupled negative affinity antibodies specific for corneal proteins which are present on contaminant cells such as stromal and/or epithelial cells and which are not present on human corneal endothelial cells (negative selection).

Once the antibody is bound to the cell, the bound cells are separated in accordance with the specific antibody preparation. For example, FACS separation may be used with fluorochrome labeled antibodies, immunomagnetic selection may be used with magnetic-labeled antibodies, "panning" may be employed with immobilized antibodies, and so forth.

Cells may be separated from affinity antibodies using known techniques, as desired. As a specific example, where an antibody in an immunopanning process is a positive selection antibody, the matrix with attached endothelial cells may be washed to remove unbound cells and the endothelial cells released using a suitable technique (e.g., trypsin digest).

While various specific embodiments employing antibodies as affinity reagents are specifically described herein, it is to be understood that other affinity reagents for binding positive or negative cell markers can be used in the same fashion, including nucleic acid aptamers and other engineered forms of protein scaffolds. Aptamers are synthetic oligonucleotides selected from pools of random-sequence oligonucleotides which bind to a wide range of biomolecular targets with high affinity and specificity. See, e.g., J. Wang and G. Li, "Aptamers against cell surface receptors: selection, modification and application," *Curr Med Chem*. 2011; 18(27):4107-16.

The separated cells may be collected in any appropriate medium that maintains the viability of the cells.

Cell populations enriched with HCECs may thus be achieved in this manner. The HCEC population may constitute 50% or more of the cells in the cell composition, preferably at 75% or more of the cells in the cell composition, more preferably at 90% or more of the cells in the cell composition, and may be as many as 95% or more (e.g. substantially pure) of the cells in the cell population. Conversely, the cell populations may contain up to 50% of cells other than HCECs (e.g., corneal keratocytes, etc.), for instance 50% or less of such cells, preferably 25% or less of such cells, more preferably 10% or less of such cells, and may be as few as 5% or less of such cells.

The enriched cell population may be used immediately or stored. For example, at room temperature, at 4° C., at 37° C. or the cells may be frozen at liquid nitrogen temperatures and stored for long periods of time.

In certain embodiments, the enriched cells may be further expanded in vitro by adding culture media as described widely in the literature. See, e.g., Li W et al., *Invest Ophthalmol Vis Sci* 2007; 48: 614.; Ishino Y et al., *Invest Ophthalmol Vis Sci* 2004; 45: 800; Chen K H et al., *Cornea* 2001; 20: 731.

The enriched HCEC compositions thus obtained have a variety of uses in clinical therapy, research, development, and commercial purposes.

For example, for therapeutic purposes, human corneal endothelial cells may be ocularly administered to an eye of a patient in order to treat corneal endothelial cell loss or dysfunction.

Other aspects of the invention pertain to kits for conducting cell separations as described herein. Such kits may include any combination of the following, among other elements: (a) one, two, three or more positive affinity reagents, each of which may be, for example, in the form of a positive affinity antibody attached to a suitable substrate such as a solid matrix (e.g. a plate, immobilized bead, etc.) or label (e.g., magnetic label, fluorescent label, etc.), (b) one, two, three or more unlabeled positive affinity antibodies, which the end user could label using standard methods, choosing their preferred labels (e.g., fluorophores, haptens, etc.), (c) one, two, three or more negative affinity reagents, each of which may be, for example, in the form of a negative affinity antibody attached to a suitable substrate such as a solid matrix (e.g. a plate, immobilized bead, etc.) or label (e.g., magnetic label, fluorescent label, etc.), (d) or one, two, three or more unlabeled negative affinity antibodies, which the end user could label using standard methods, choosing their preferred labels (e.g., fluorophores, haptens, etc.); (e) a combination of (a) and (c); (f) a combination of (b) and (d); (g) packaging; (h) printed materials with one or more of the following: (i) storage information and (ii) instructions regarding how to use the materials contained in the kit (e.g., positive affinity reagents, negative affinity reagents, a combination of antibodies for sequential use, etc.).

Example 1

HCECs were isolated from cadaveric donor corneas (Tampa Lions Eye Bank) and cultured and expanded following the method described by Joyce and Zhu in *Cornea.* 2004 November; 23(8 Suppl):S8-S19. Briefly, the endothelium and Descemet's membrane were peeled off of the stroma and after overnight stabilization at 37° C. in Opti-MEMO media (Gibco, Life Technologies Corp, Carlsbad, Calif.), supplemented with 8% fetal bovine serum (FBS), they were incubated for 1 hr at 37° C. with ethylenediaminetetraacetic acid (EDTA) to loosen up the cell-cell interactions. Cells were then mechanically dissociated to obtain a single-cell suspension, they were seeded onto FNC-coated culture wells and labeled as "P0" (passage zero). After reaching confluency, they were trypsinized and further expanded into more wells to increase their number. After one or two rounds of expansion, cells were collected and incubated with different antibodies as indicated below. Keratocytes were also obtained from cadaveric donor corneas using the method described by Stramer et al. in "Monoclonal antibody (3G5)-defined ganglioside: cell surface marker of corneal keratocytes," *Invest. Ophthalmol. Vis. Sci.* 2004 vol. 45 no. 3 807-812. While one of the HCEC cultures preserved its typical cobblestone morphology at passage 2 (FIG. 1A), a second culture underwent endothelial-to-mesenchymal transition during passage 3 (P3) and the cells became fibroblastic (FIG. 1B). Such cells are generally referred to herein as human corneal endothelial cells of lower utility (e.g., HCECs that have undergone fibroblastic or mesenchymal transformation, etc.) The keratocyte culture exhibits the typical fibroblastic, elongated cell morphology (FIG. 1C).

HCECs from each culture and keratocytes were collected and incubated with one or more of the following labelled antibodies: (a) APC-CD56 which is a mouse monoclonal antibody against a protein product of gene X15 from Table 2 (referred herein to as CD56 surface protein) coupled to allophycocyanin (BD Biosciences, #555518), (b) PE-CD166, which is a mouse monoclonal antibody against a protein product of gene X1 from Table 2 (referred here to as CD166 surface protein) coupled to phycoerythin (BD Biosciences #559263), (c) FITC-CAR, which is a mouse monoclonal antibody against a protein product of gene X25 from Table 2 (referred to as CAR surface protein) coupled to fluorescein-5-Isothiocyanate (Santa Cruz Biotechnology, Santa Cruz, Calif., USA # sc-56892) and (d) PECy7-CD90, which is a mouse monoclonal antibody against a protein product of gene Z8 from Table 2 (referred to as CD90 surface protein) coupled to a tandem conjugate of PE (energy donor) which has an excitation wavelength of 565 nm and Cy7 (energy acceptor) which has an emission wavelength of 778 nm) (BD Biosciences #561558).

Expression of surface markers was analyzed using a BD LSR™II flow cytometry system (BD Biosciences, San Jose, Calif.). The data shown in FIG. 2 are representative from one experiment. Similar results were obtained upon repeated experimentation. Quantification of the % positive cells for each marker shows that in fibroblastic cultures there is a decreased expression of CD56 and CAR, indicating that antibodies to these proteins may be used in conjunction with positive affinity reagents for "good" HCECs. A significant difference in the expression of CD166 or CD90 was not detected using this particular antibody.

Figure 3B:
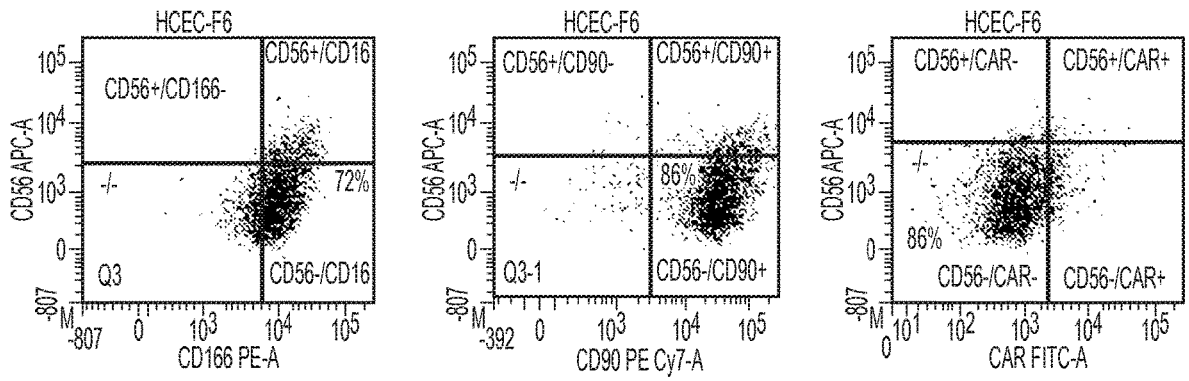
Figure 3C:
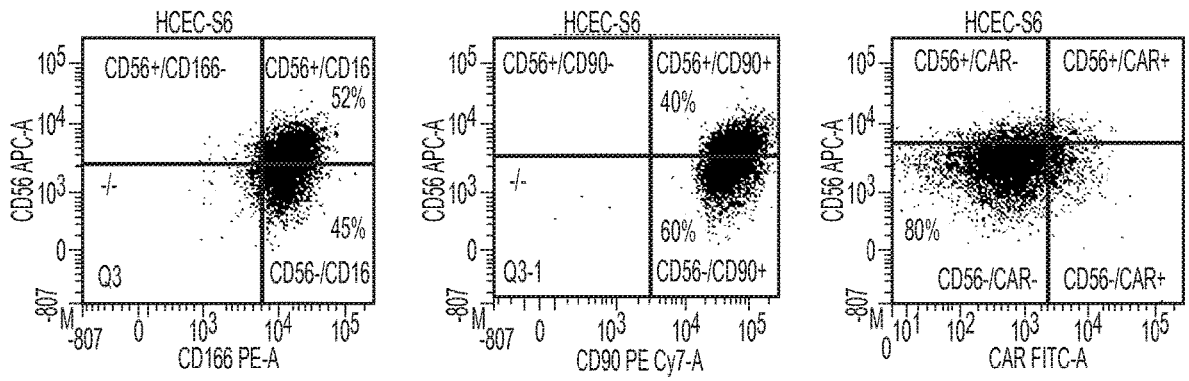

FIGS. 3A-3C are dual-color fluorescence dot plots of the HCECs and keratocytes. These dot plots show the differential expression of two surface markers in each cell population as labeled. The percent of cells positive for an individual marker is shown in FIG. 2.

Example 2

HCECs were isolated from cadaveric donor corneas as described in Example 1. Also as discussed in Example 1, HCEC cultures were obtained (a) which evidenced a typical cobblestone morphology (referred to in this Example 2 as a "canonical" cell culture), (b) where all the cells had undergone an endothelial-to-mesenchymal transition (referred to in this Example as a "fibroblastic" cell culture) and (c) where some HCECs had undergone endothelial-to-mesenchymal transition (referred to in this Example as a "mixed" cell culture).

HCEC surface markers were identified by microarray data, and several with high expression in the endothelium (cultured and freshly dissected) but low expression in stroma were selected to be tested by flow cytometry analysis. In addition to APC-CD56, PE-CD166, FITC-CAR and PECy7-CD90 described in Example 1, also tested were (e) CD109-PE, (i.e., mouse anti-CD109), which is a monoclonal antibody against a protein product of gene Y6 from Table 2 (referred to as CD109 antigen) conjugated to phycoerythrin (PE), BD Biosciences Cat #556040 and (f) CD 248-BV, (i.e., mouse anti-Endosialin), which is an unconjugated monoclonal antibody against a protein product of gene X5 from Table 2 (referred to as CD248 antigen or Endosialin), (Millipore, Temecula, Calif., USA, Cat # MAB2626), incubated with Goat polyclonal anti-Mouse IgG secondary antibody conjugated to Brilliant Violent 421 (Biolegend, Inc., San Diego, Calif., USA, Cat #405317).

Figure 4:
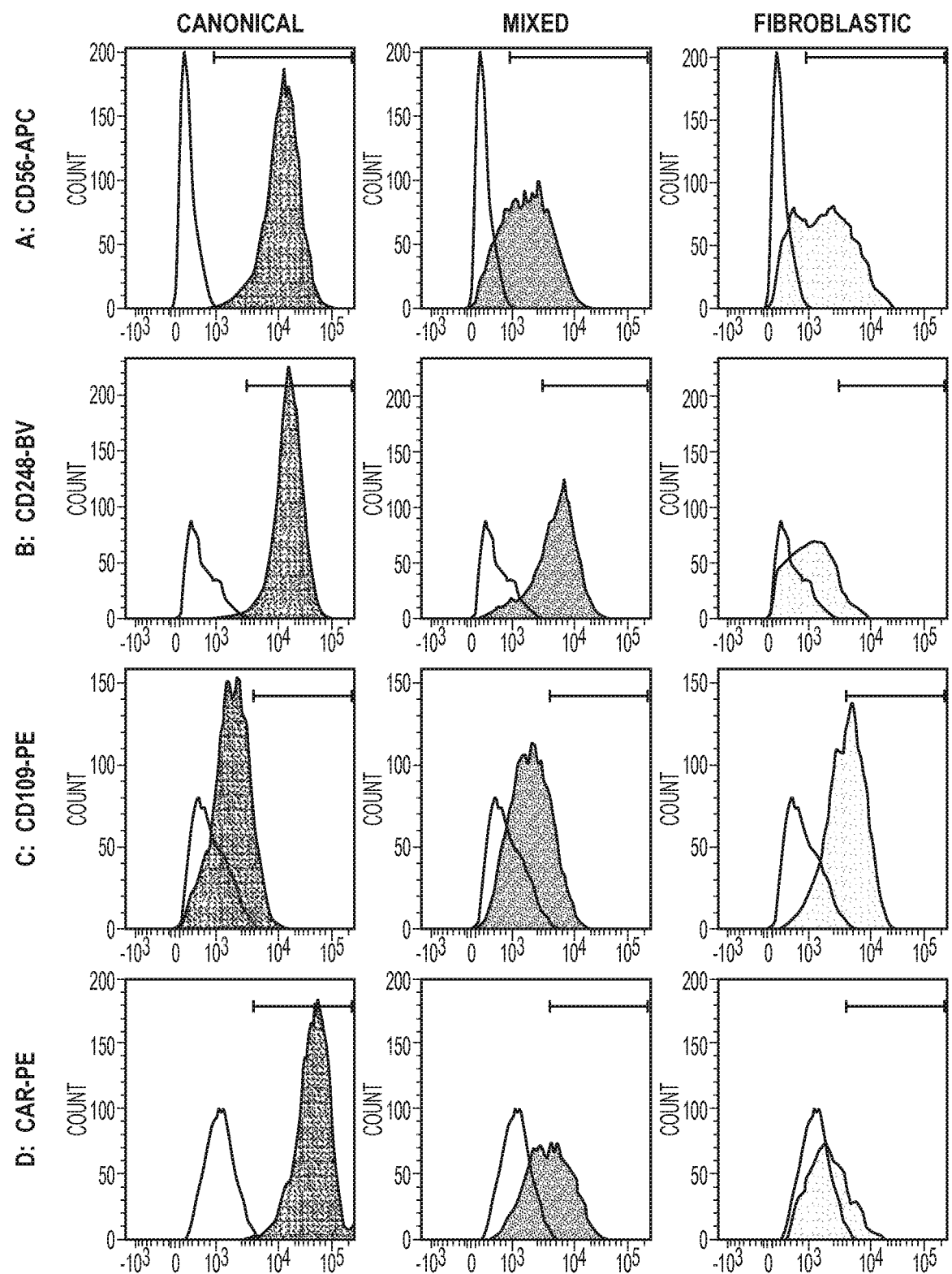
FIGS. 4A-4D presents Fluorescence profiles illustrating expression of four surface markers, specifically, CD56 (FIG. 4A), CAR (FIG. 4B), CD109 (FIG. 4C) and CD248 (FIG. 4D) in in three different HCEC populations, specifically, canonical (good) HCECs, mixed (canonical and fibroblastic) HCECs, and fibroblastic HCECs), analyzed by flow cytometry.
Figure 5:
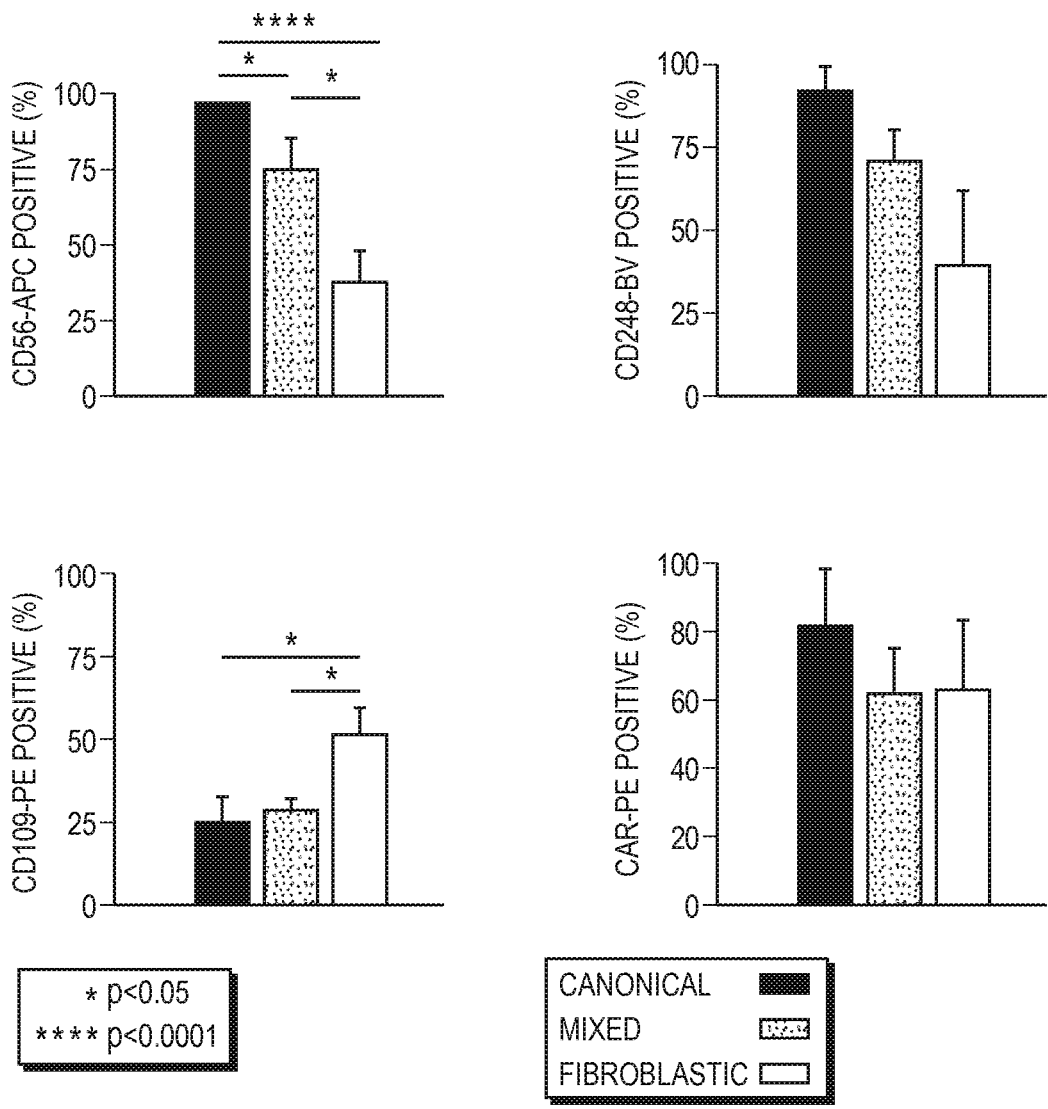
FIG. 5 illustrates in bar graph form expression of four surface markers in three different HCEC populations analyzed by flow cytometry.

To address whether the expression of those markers in HCECs were affected by the fibroblastic conversion described above, HCEC cultures demonstrating two different morphologies (canonical and fibroblastic) and a corneal keratocyte culture as a control were immunostained for the surface proteins CD90, CAR, CD56 and CD166 (See Example 1, FIG. 2). CD56, CAR, CD109 and CD248 expression was also compared between canonical (good), mixed, and fibroblastic HCECs (see FIGS. 4 and 5). Analysis of the percentage of cells expressing any of the individual markers in canonical and fibroblastic cultures demonstrated that CD56, CAR and CD248 expression was reduced in the fibroblastic culture (see FIG. 5), while CD109 was elevated (see FIG. 5); CD90 and CD166 expression did not significantly change between good/canonical and fibroblastic cultures (see Example 1, FIG. 2). A comparable trend was observed in the keratocyte culture used as control for CD90, CAR, CD56 and CD166 expression (see Example 1, FIG. 2).

Figure 6:
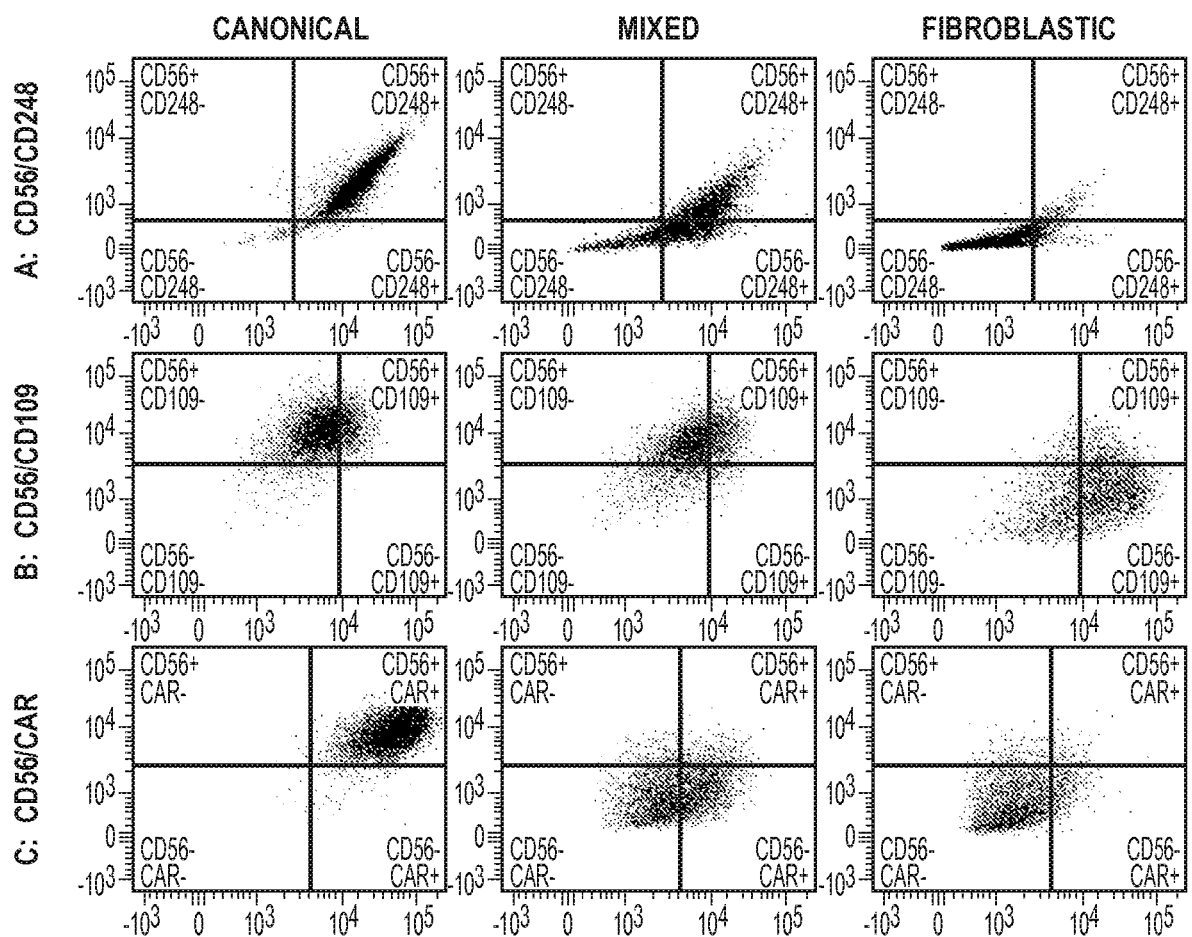
FIG. 6 illustrates dual-color fluorescence histograms for various pairs of surface markers specifically, CD56:CD248 (FIG. 6A), CD56:CD109 (FIG. 6B) and CD56:CAR (FIG. 6C) in three different HCEC populations, specifically, canonical HCECs, mixed HCECs and fibroblastic HCECs.

Dot plot dual histograms of canonical, mixed and fibroblastic cultures shown in FIG. 6 demonstrated that canonical HCECs are predominantly CD56, CD248 and CAR positive, and CD109 negative; CD56 and CD248 expression is lost and CD109 expression increases as the culture becomes fibroblastic.

Figure 7:
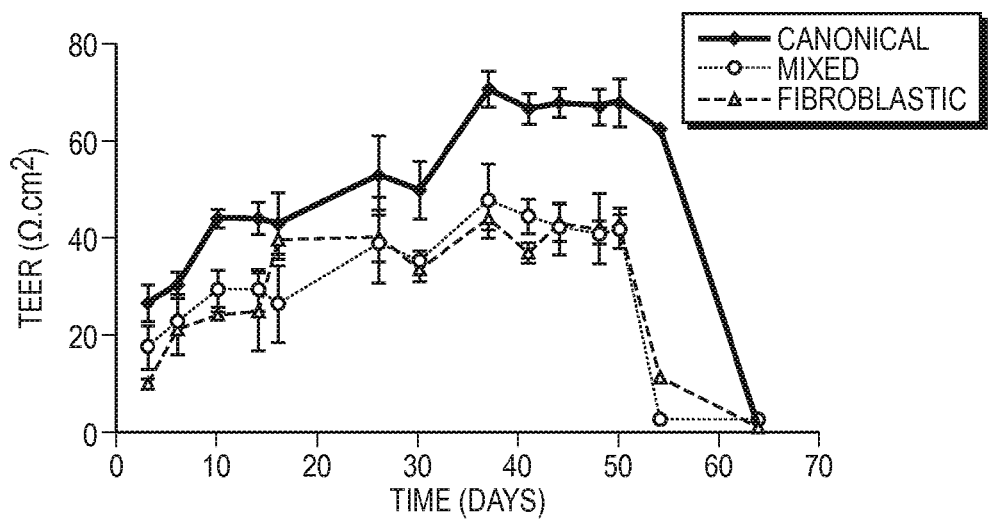
FIG. 7 illustrates trans-endothelial electrical resistance (TEER) as a function of time for cell cultures of three different HCEC populations.

Finally, trans-endothelial electrical resistance (TEER) of cell cultures was measured. HCECs (a) from "good" or "canonical" cultures that expressed high levels of CD56, (b) from mixed cultures and (c) from fibroblastic cultures were plated onto inserts with 0.4 mm pores in 24-well culture plates (Transwell, Corning Costar, Acton, Mass.) at a density of 20,000 cells/insert and incubated in growth media as described in Example 1. TEER was measured using an EVOM volt-ohm meter with STX2 Electrode (World Precision Instrument, Inc., Sarasota, Fla.) for up to 65 days after initial plating. TEER measures the apical and basal plasma membrane resistance and the paracellular resistance and is used as an index of monolayer confluence integrity of tight junctions. To calculate final resistance ($\Omega \cdot cm2$), the resistance of blank filters were subtracted from those of filters with cells. Four wells per condition were averaged. HCECs exhibiting a canonical morphology and being CD56-positive demonstrated a superior barrier formation ability measured by TEER (FIG. 7).

Thus, we have identified a panel of surface makers that can be used to characterize a canonical and functionally superior HCEC culture, and may be used as quality control criteria or to potentially separate the best HCEC subpopulations for expansion.

Although various embodiments are specifically illustrated and described herein, it will be appreciated that modifications and variations of the present invention are covered by the above teachings and are within the purview of any appended claims without departing from the spirit and intended scope of the invention.

APPENDIX A

TABLE 2

Gene ID:
X1

Gene symbol:
ALCAM

Gene description:
activated leukocyte cell adhesion molecule

Unigene:
Hs.591293

Genbank:
DQ486139

Entrez Gene:
214

Refseq:
NM_001627

Protein sequence (SEQ ID NO (1)):
```
  1 meskgasscr llfcllisat vfrpglgwyt vnsaygdtii ipcrldvpqn lmfgkwkyek
 61 pdgspvfiaf rsstkksvqy ddvpeykdrl nlsenytlsi snarisdekr fvcmlvtedn
121 vfeaptivkv fkqpskpeiv skalfleteq lkklgdcise dsypdgnitw yrngkvlhpl
181 egavviifkk emdpvtqlyt mtstleyktt kadiqmpftc svtyygpsgq ktihseqavf
241 diyypteqvt iqvlppknai kegdnitlkc lgngnpppee flfylpgqpe girssntytl
301 tdvrrnatgd ykcslidkks miastaitvh yldlslnpsg evtrqigdal pvsctisasr
361 natvvwmkdn irlrsspsfs slhyqdagny vcetalqeve glkkresltl ivegkpqikm
421 tkktdpsgls ktiichvegf pkpaiqwtit gsgsvinqte espyingryy skiiispeen
```

TABLE 2-continued

```
481 vtltctaenq lertvnslnv saisipehde adeisdenre kvndqakliv givvglllaa
541 lvagvvywly mkksktaskh vnkdlgnmee nkkleennhk tea
```

Gene ID:
X2

Gene symbol:
ATP1A1

Gene description:
sodium/potassium-transporting ATPase subunit alpha-1

Unigene:
Hs.371889

Genbank:
BC003077

Entrez Gene:
476

Refseq:
NM_000701|NM_001160233|NM_001160234

Protein sequence isoform a (SEQ ID NO (2)):
```
   1 mgkgvgrdky epaavseqgd kkgkkgkkdr dmdelkkevs mddhklslde lhrkygtdls
  61 rgltsaraae ilardgpnal tpppttpewi kfcrqlfggf smllwigail cflaysiqaa
 121 teeepqndnl ylgvvlsavv iitgcfsyyq eaksskimes fknmvpqqal virngekmsi
 181 naeevvvgdl vevkggdrip adlriisang ckvdnssltg esepqtrspd ftnenpletr
 241 niaffstncv egtargivvy tgdrtvmgri atlasglegg qtpiaaeieh fihiitgvav
 301 flgvsffils lileytwlea vifligiiva nvpegllatv tvcltltakr marknclvkn
 361 leavetlgst sticsdktgt ltqnrmtvah mwfdnqihea dttenqsgvs fdktsatwla
 421 lsriaglcnr avfqanqenl pilkravagd asesallkci elccgsvkem reryakivei
 481 pfnstnkyql sihknpntse pqhllvmkga perildrcss illhgkeqpl deelkdafqn
 541 aylelgglge rvlgfchlfl pdeqfpegfq fdtddvnfpi dnlcfvglis midppraavp
 601 davgkcrsag ikvimvtgdh pitakaiakg vgiisegnet vediaarlni pvsqvnprda
 661 kacvvhgsdl kdmtseqldd ilkyhteivf artspqqkli ivegcqrqga ivavtgdgvn
 721 dspalkkadi gvamgiagsd vskqaadmil lddnfasivt gveegrlifd nlkksiaytl
 781 tsnipeitpf lifiianipl plgtvtilci dlgtdmvpai slayeqaesd imkrqprnpk
 841 tdklvnerli smaygqigmi qalggffftyf vilaengflp ihllglrvdw ddrwindved
 901 sygqqwtyeq rkiveftcht affvsivvvq wadlvicktr rnsvfqqgmk nkilifglfe
 961 etalaaflsy cpgmgvalrm yplkptwwfc afpysllifv ydevrkliir rrpggwveke
1021 tyy
```

Protein sequence isoform c (SEQ ID NO (3)):
```
   1 mafkvgrdky epaavseqgd kkgkkgkkdr dmdelkkevs mddhklslde lhrkygtdls
  61 rgltsaraae ilardgpnal tpppttpewi kfcrqlfggf smllwigail cflaysiqaa
 121 teeepqndnl ylgvvlsavv iitgcfsyyq eaksskimes fknmvpqqal virngekmsi
 181 naeevvvgdl vevkggdrip adlriisang ckvdnssltg esepqtrspd ftnenpletr
 241 niaffstncv egtargivvy tgdrtvmgri atlasglegg qtpiaaeieh fihiitgvav
 301 flgvsffils lileytwlea vifligiiva nvpegllatv tvcltltakr marknclvkn
 361 leavetlgst sticsdktgt ltqnrmtvah mwfdnqihea dttenqsgvs fdktsatwla
 421 lsriaglcnr avfqanqenl pilkravagd asesallkci elccgsvkem reryakivei
 481 pfnstnkyql sihknpntse pqhllvmkga perildrcss illhgkeqpl deelkdafqn
 541 aylelgglge rvlgfchlfl pdeqfpegfq fdtddvnfpi dnlcfvglis midppraavp
 601 davgkcrsag ikvimvtgdh pitakaiakg vgiisegnet vediaarlni pvsqvnprda
 661 kacvvhgsdl kdmtseqldd ilkyhteivf artspqqkli ivegcqrqga ivavtgdgvn
 721 dspalkkadi gvamgiagsd vskqaadmil lddnfasivt gveegrlifd nlkksiaytl
 781 tsnipeitpf lifiianipl plgtvtilci dlgtdmvpai slayeqaesd imkrqprnpk
 841 tdklvnerli smaygqigmi qalggffftyf vilaengflp ihllglrvdw ddrwindved
 901 sygqqwtyeq rkiveftcht affvsivvvq wadlvicktr rnsvfqqgmk nkilifglfe
 961 etalaaflsy cpgmgvalrm yplkptwwfc afpysllifv ydevrkliir rrpggwveke
1021 tyy
```

Protein sequence isoform d (SEQ ID NO (4)):
```
   1 mdelkkevsm ddhklsldel hrkygtdlsr gltsaraaei lardgpnalt ppptttpewik
  61 fcrqlfggfs mllwigailc flaysiqaat eeepqndnly lgvvlsavvi itgcfsyyqe
 121 aksskimesf knmvpqqalv irngekmsin aeevvvgdlv evkggdripa dlriisangc
 181 kvdnssltge sepqtrspdf tnenpletrn iaffstncve gtargivvyt gdrtvmgria
 241 tlasgleggq tpiaaeiehf ihiitgvavf lgvsffilsl ileytwleav ifligiivan
 301 vpegllatvt vcltltakrm arknclvknl eavetlgsts ticsdktgtl tqnrmtvahm
 361 wfdnqihead ttenqsgvsf dktsatwlal sriaglcnra vfqanqenlp ilkravagda
 421 sesallkcie lccgsvkemr eryakiveip fnstnkyqls ihknpntsep qhllvmkgap
 481 erildrcssi llhgkeqpld eelkdafqna ylelgglger vlgfchlflp deqfpegfqf
 541 dtddvnfpid nlcfvglism idppraavpd avgkcrsagi kvimvtgdhp itakaiakgv
 601 giisegnetv ediaarlnip vsqvnprdak acvvhgsdlk dmtseqlddi lkyhteivfa
 661 rtspqqklii vegcqrqgai vavtgdgvnd spalkkadig vamgiagsdv skqaadmill
 721 ddnfasivtg veegrlifdn lkksiaytlt snipeitpfl ifiianiplp lgtvtilcid
 781 lgtdmvpais layeqaesdi mkrqprnpkt dklvnerlis maygqigmiq alggffftyfv
```

TABLE 2-continued

```
841 ilaengflpi hllglrvdwd drwindveds ygqqwtyeqr kiveftchta ffvsivvvqw
901 adlvicktrr nsvfqqgmkn kilifglfee talaaflsyc pgmgvalrmy plkptwwfca
961 fpysllifvy devrkliirr rpggwveket yy
```

Gene ID:
X3

Gene symbol:
CD200

Gene description:
CD 200 molecule

Unigene:
Hs.79015

Genbank:
AK297194|AF063591|BC022522|BC031103|AY603771|AK293399

Entrez Gene:
4345

Refseq:
NM_001004196|NM_005944

Protein sequence isoform b (SEQ ID NO (5)):
```
  1 merltltrti ggplltatll gkttindyqv irmpfshlst yslvwvmaav vlctaqvqvv
 61 tqdereqlyt paslkcslqn aqealivtwq kkkavspenm vtfsenhgvv iqpaykdkin
121 itqlglqnst itfwnitled egcymclfnt fgfgkisgta cltvyvqpiv slhykfsedh
181 lnitcsatar papmvfwkvp rsgienstvt lshpngttsv tsilhikdpk nqvgkevicq
241 vlhlgtvtdf kqtvnkgywf svplllsivs lvillvlisi llywkrhrnq drep
```

Protein sequence isoform a (SEQ ID NO (6)):
```
  1 merlvirmpf shlstyslvw vmaavvlcta qvqvvtqder eqlytpaslk cslqnaqeal
 61 ivtwqkkkav spenmvtfse nhgvviqpay kdkinitqlg lqnstitfwn itledegcym
121 clfntfgfgk isgtacltvy vqpivslhyk fsedhlnitc satarpapmv fwkvprsgie
181 nstvtlshpn gttsvtsilh ikdpknqvgk evicqvlhlg tvtdfkqtvn kgywfsvpll
241 lsivslvill vlisillywk rhrnqdrep
```

Gene ID:
X4

Gene symbol:
LAMB1

Gene description:
laminin, beta 1

Unigene:
Hs.650585

Genbank:
M61916

Entrez Gene:
3912

Refseq:
NM_002291

Protein sequence (SEQ ID NO (7)):
```
   1 mgllqllafs flalcrarvr aqepefsygc aegscypatg dlligraqkl svtstcglhk
  61 pepycivshl qedkkcficn sqdpyhetln pdshlienvv ttfapnrlki wwqsengven
 121 vtiqldleae fhfthlimtf ktfrpaamli erssdfgktw gvyryfaydc easfpgistg
 181 pmkkvddiic dsrysdieps tegevifral dpafkiedpy spriqnllki tnlrikfvkl
 241 htlgdnllds rmeirekyyy avydmvvrgn cfcyghasec apvdgfneev egmvhghcmc
 301 rhntkglnce lcmdfyhdlp wrpaegrnsn ackkcncneh sischfdmav ylatgnvsgg
 361 vcddcqhntm grnceqckpf yyqhperdir dpnfcerctc dpagsqnegi cdsytdfstg
 421 liagqcrckl nvegehcdvc kegfydlsse dpfgckscac nplgtipggn pcdsetghcy
 481 ckrlvtgqhc dqclpehwgl sndldgcrpc dcdlggalnn scfaesgqcs crphmigrqc
 541 nevepgyyfa tldhylyeae eanlgpgvsi verqyiqdri pswtgagfvr vpegayleff
 601 idnipysmey diliryepql pdhwekavit vqrpgripts srcgntipdd dnqvvslspg
 661 sryvvlprpv cfekgtnytv rlelpqytss dsdvespytl idslvlmpyc ksldiftvgg
 721 sgdgvvtnsa wetfqryrcl ensrvvktp mtdvcrniif sisallhqtg lacecdpqgs
 781 lssvcdpngg qcqcrpnvvg rtcnrcapgt fgfgpsgckp cechlqgsvn afcnpvtgqc
 841 hcfqgvyarq cdrclpghwg fpscqpcqcn ghaddcdpvt geclncqdyt mghncercla
 901 gyygdpiigs gdhcrpcpcp dgpdsgrqfa rscyqdpvtl qlacvcdpgy igsrcddcas
 961 gyfgnpsevg gscqpcqchn nidttdpeac dketgrclkc lyhtegehcq fcrfgyygda
1021 lqqdcrkcvc nylgtvqehc ngsdcqcdka tgqclclpnv igqncdrcap ntwqlasgtg
1081 cdpcncnaah sfgpscneft gqcqcmpgfg grtcsecqel fwgdpdvecr acdcdprgie
```

TABLE 2-continued

```
1141 tpqcdqstgq cvcvegvegp rcdkctrgys gvfpdctpch qcfalwdvii aeltnrthrf
1201 lekakalkis gvigpyretv dsverkvsei kdilaqspaa eplknignlf eeaeklikdv
1261 temmaqvevk lsdttsqsns takeldslqt eaesldntvk elaeqlefik nsdirgalds
1321 itkyfqmsle aeervnastt epnstveqsa lmrdrvedvm meresqfkek qeeqarllde
1381 lagklqsldl saaaemtcgt ppgascsete cggpncrtde gerkcggpgc gglvtvahna
1441 wqkamdldqd vlsalaeveq lskmvseakl radeakqsae dillkntnatk ekmdksneel
1501 rnlikqirnf ltqdsadlds ieavanevlk mempstpqql qnltedirer veslsqvevi
1561 lqhsaadiar aemlleeakr asksatdvkv tadmvkeale eaekaqvaae kaikqadedi
1621 qgtqnlltsi esetaaseet lfnasqrise lernveelkr kaaqnsgeae yiekvvytvk
1681 qsaedvkktl dgeldekykk venliakkte esadarrkae mlqneaktll aqansklqll
1741 kdlerkyedn qryledkaqe larlegevrs llkdisqkva vystcl
```

Gene ID:
X5

Gene symbol:
CD248

Gene description:
endosialin

Unigene:
Hs.195727

Genbank:
AF279142

Entrez Gene:
57124

Refseq:
NM_020404

Protein sequence (SEQ ID NO (8)):
```
  1 mllrllllawa aagptlgqdp waaepraacg psscyalfpr rrtfleawra crelggdlat
 61 prtpeeaqrv dslvgagpas rllwiglqrq arqcqlqrpl rgftwttgdq dtaftnwaqp
121 asggpcpaqr cvaleasgeh rwlegsctla vdgylcqfgf egacpalqde agqagpavyt
181 tpfhlvstef ewlpfgsvaa vqcqagrgas llcvkqpegg vgwsragplc lgtgcspdng
241 gcehecveev dghvscrcte gfrlaadgrs cedpcaqapc eqqcepggpq gyschcrlgf
301 rpaeddphrc vdtdecqiag vcqqmcvnyv ggfecycseg headgisc spagamgqaa
361 sqdlgdelld dgedeedede awkafnggwt empgilwmep tqppdfalay rpsfpedrep
421 qipypeptwp pplsaprvpy hssvlsvtrp vvvsathptl psaqhppvip athpalsrdh
481 qipviaanyp dlpsayqpgi lsvshsaqpp ahqppmistk ypelfpahqs pmfpdtrvag
541 tqttthlpgi ppnhaplvtt lgaqlppqap dalvlrtqat qlpiiptaqp sltttsrspv
601 spahqisvpa atqpaalptl lpsqsptnqt spispthphs kapqipredg pspklalwlp
661 spaptaapta lgeaglaehs qrddrwllva llvptcvflv vllalgivyc trcgphapnk
721 ritdcyrwvi hagsksptep mpprgsltgv qtcrtsv
```

Gene ID:
X6

Gene symbol:
COL4A6

Gene description:
collagen, type IV, alpha 6

Unigene:
Hs.145586

Genbank:
D21337

Entrez Gene:
1288

Refseq:
NM_033641|NM_001847

Protein sequence isoform b (SEQ ID NO (9)):
```
  1 mhpglwlllv tlclteelaa ageksygkpc ggqdcsgscq cfpekgargr pgpigiqgpt
 61 gpqgftgstg lsglkgergf pglllgpygpk gdkgpmgvpg flgingipgh pgqpgprgpp
121 gldgcngtqg avgfpdpgy pgllgpplp gqkgskgdpv lapgsfkgmk gdpglpgldg
181 itgpqgapgf pgavgpagpp glqgppgpps plgpdgnmgl gfqggekgvkg dvglpgpagp
241 ppstgelefm gfpkgkkgsk gepgpkgfpg isgppgfpgl gttgekgekg ekgipglpgp
301 rgpmgsegvq gppgqqgkkg tlgfpglngf qgiegqkgdi glpgpdvfid idgavisgnp
361 gdpgvpglpg lkgdegiqgl rgpsvpglp alsgvpgalg pqgfpglkgd qqnpgrttig
421 aaglpgrdgl pgpgpppgpp spefetetlh nkesgfpglr geqgpkgnlg lkgikgdsgf
481 cacdggvpnt gppgepgppg pwgliglpgl kgargdrgsg gaqgpagapg lvgplgpsgp
541 kgkkgepils tiqgmpgdrg dsgsqgfrgv igepgkdgvp glpglpglpg dggqgfpgek
```

TABLE 2-continued

```
 601 glpglpgekg  hpgppglpgn  glpglpgprg  lpgdkgkdgl  pgqqglpgsk  gitlpciipg
 661 sygpsgfpgt  pgfpgpkgsr  glpgtpgqpg  ssgskgepgs  pglvhlpelp  gfpgprgekg
 721 lpgfpglpgk  dglpgmigsp  glpgskgatg  difgaengap  geqglqgltg  hkgflgdsgl
 781 pglkgvhgkp  gllgpkgerg  spgtpgqvgq  pgtpgssgpy  gikgkslpg   apgfpgisgh
 841 pgkkgtrgkk  gppgsivkkg  lpglkglpgn  pglvglkgsp  gspgvaglpa  lsgpkgekgs
 901 vgfvgfpgip  glpgipgtrg  lkgipgstgk  mgpsgragtp  gekgdrgnpg  pvgipsprrp
 961 msnlwlkgdk  gsqgsagsng  fpgprgdkge  agrpgppglp  gapglpgiik  gvsgkpgppg
1021 fmgirglpgl  kgssgitgfp  gmpgesgsqg  irgspglpga  sglpglkgdn  gqtveisgsp
1081 gpkgqpgesg  fkgtkgrdgl  ignigfpgnk  gedgkvgvsg  dvglpgapgf  pgvagmrgep
1141 glpgssghqg  aigplgspgl  igpkgfpgfp  glhglnglpg  tkgthgtpgp  sitgvpgpag
1201 lpgpkgekgy  pgigigapgk  pglrgqkgdr  gfpglqgpag  lpgapgislp  sliagqpgdp
1261 grpgldgerg  rpgpagppgp  pgpssnqgdt  gdpgfpgipg  pkgpkgdqgi  pgfsglpgel
1321 glkgmrgepg  fmgtpgkvgp  pgdpgfpgmk  gkagprgssg  lqgdpgqgtp  aeavqvpgsp
1381 lglpgidgip  gltgdpgaqg  pvglqgsgl   pgipgkdgps  glpgppgalg  dpglpglqgp
1441 pgfegapgqq  gpfgmpgmpg  qsmrvgytlv  khsqseqvpp  cpigmsqlwv  gysllfvegq
1501 ekahnqdlgf  agsclprfst  mpfiycnine  vchyarrndk  sywlsttapi  pmmpvsqtqi
1561 pqyisrcsvc  eapsqaiavh  sqditipqcp  lgwrslwigy  sflmhtaaga  egggqslvsp
1621 gscledfrat  pfiecsgarg  tchyfankys  fwlttveerq  qfgelpvset  lkagqlhtrv
1681 srcqvcmksl
```

Protein sequence isoform a (SEQ ID NO (10)):

```
   1 mlinklwlll  vtlclteela  aagecksygkp  cggqdcsgsc  qcfpekgarg  rpgpigiqgp
  61 tgpqgftgst  glsglkgerg  fpgllpygp   kgdkgpmgvp  gflginginp  hpgqpgprgp
 121 pgldgcngtq  gavgfpgpdg  ypgllgppgl  pgqkgskgdp  vlapgsfkgm  kgdpglpgld
 181 gitgpqgapg  fpgavgpagp  pglqgppgpp  gplgpdgnmg  lgfqgekgvk  gdvglpgapg
 241 pppstgelef  mgfpkgkkgs  kgepgpkgfp  gisgpgfpg   lgttgekgek  gekgipglpg
 301 prgpmgsegv  qgppgqqgkk  gtlgfpglng  fqgiegqkgd  iglpgpdvfi  didgavisgn
 361 pgdpgvpglp  glkgdegiqg  lrgpsgvpgl  palsgvpgal  gpqgfpglkg  dqgnpgrtti
 421 gaaglpgrdg  lpgppgppgp  pspefetetl  hnkesgfpgl  rgeqgpkgnl  glkgikgdsg
 481 fcacdggvpn  tgppgepgpp  gpwgliglpg  lkgargdrgs  ggaqgpagap  glvglgpgsg
 541 pkgkkgepil  stiqgmpgdr  gdsgsqgfrg  vigepgkdgv  pglpglpglp  gdggqgfpge
 601 kglpglpgek  ghpgpplpg   nglpglpgpr  glpgdkgkdg  lpgqqglpgs  kgitlpciip
 661 gsygpsgfpg  tpgfpgpkgs  rglpgtpgqp  gssgskgepg  spglvhlpel  pgfpgprgek
 721 glpgfpglpg  kdglpgmigs  plpgskgat   gdifgaenga  pgeqglqglt  ghkgflgdsg
 781 lpglkgvhgk  pgllgpkger  gspgtpgqvg  qpgtpgssgp  ygikgkslp   gapgfpgisg
 841 hpgkkgtrgk  kgppgsivkk  glpglkglpg  npglvglkgs  pgspgvaglp  alsgpkgekg
 901 svgfvgfpgi  pglpgipgtr  glkgipgstg  kmgpsgragt  pgekgdrgnp  gpvgipsprr
 961 pmsnlwlkgd  kgsqgsagsn  gfpgprgdkg  eagrpgppgl  pgapglpgii  kgvsgkpgpp
1021 gfmgirglpg  lkgssgitgf  pgmpgesgsq  girgspglpg  asglpglkgd  ngqtveisgs
1081 pgpkgqpges  gfkgtkgrdg  lignigfpgn  kgedgkvgvs  gdvglpgapg  fpgvagmrge
1141 pglpgssghq  gaigplgspg  ligpkgfpgf  pglhglnglp  gtkgthgtpg  psitgvpgpa
1201 glpgpkgekg  ypgigigapg  kpglrgqkgd  rgfpglqgpa  glpgapgisl  psliagqpgd
1261 pgrpgldger  grpgpagppg  ppgpssnqgd  tgdpgfpgip  gpkgpkgdqg  ipgfsglpge
1321 lglkgmrgep  gfmgtpgkvg  ppgdpgfpgm  kgkagprgss  glqgdpgqtp  taeavqvpgg
1381 plglpgidgi  pgltgdpgaq  gpvglqgskg  lpgipgkdgp  sglpgppgal  gdpglpglqg
1441 ppgfegapgq  qgpfgmpgmp  gqsmrvgytl  vkhsqseqvp  pcpigmsqlw  vgysllfveg
1501 qekahnqdlg  fagsclprfs  tmpfiycnin  evchyarrnd  ksywlsttap  ipmmpvsqtq
1561 ipqyisrcsv  ceapsqaiav  hsqditipqc  plgwrslwig  ysflmhtaag  aegggqslvs
1621 pgscledfra  tpfiecsgar  gtchyfanky  sfwlttveer  qqfgelpvse  tlkagqlhtr
1681 vsrcqvcmks  l
```

Gene ID:
X7

Gene symbol:
PCDH7

Gene description:
protocadherin 7

Unigene:
Hs.479439|Hs.724529

Genbank:
AB006755

Entrez Gene:
5099

Refseq:
NM_032456|NM_002589|NM_032457|NM_001173523

Protein sequence isoform b (SEQ ID NO (11)):

```
   1 mlrmrtagwa  rgwclgccll  lplslslaaa  kqllryrlae  egpadvrign  vasdlgivtg
  61 sgevtfsles  gseylkidnl  tgelstserr  idreklpqcq  mifdenecfl  dfevsvigps
 121 qswvdlfegq  vivldindnt  ptfpspvltl  tveenrpvgt  lyllptatdr  dfgrngiery
 181 ellqepgggg  sggesrraga  adsapypggg  gngasgggsg  gskrrldase  ggggtnpggr
 241 ssvfelqvad  tpdgekqpql  ivkgaldreq  rdsyeltlrv  rdggdpprss  qailrvlitd
 301 vndnsprfek  svyeadlaen  sapgtpilql  raadldvgvn  gqieyvfgaa  tesvrrlllr
 361 detsgwlsvl  hridreevnq  lrftvmardr  gqppktdkat  vvlnikdend  nvpsieirki
```

TABLE 2-continued

```
 421 griplkdgva nvaedvlvdt pialvqvsdr dqgengvvtc tvvgdvpfql kpasdtegdq
 481 nkkkyflhts tpldyeatre fnvvivavds gspslssnns livkvgdtnd nppmfgqsvv
 541 evyfpennip gervatvlat dadsgknaei aysldssvmg ifaidpdsgd ilvntvldre
 601 qtdryefkvn akdkgipvlq gsttvivqva dkndndpkfm qdvftfyvke nlqpnspvgm
 661 vtvmdadkgr naemslyiee nnnifsiend tgtiystmsf drehqttytf rvkavdggdp
 721 prsatatvsl fvmdendnap tvtlpknisy tllppssnvr tvvatvlatd sddginadln
 781 ysivggnpfk lfeidptsgv vslvgkltqk hyglhrlvvq vndsgqpsqs ttttlvhvfvn
 841 esvsnataid sqiarslhip ltqdiagdps yeiskqrlsi vigvvagimt viliilivvm
 901 arycrsknkn gyeagkkdhe dfftpqqhdk skkpkkdkkn kkskqplyss ivtveaskpn
 961 gqrydsvnek lsdspsmgry rsvnggpgsp dlarhyksss plptvqlhpq sptagkkhqa
1021 vqdlppantf vgagdnisig sdhcseyscq tnnkyskqvr cipnifkypr eg
```

Protein sequence isoform a (SEQ ID NO (12)):
```
   1 mlrmrtagwa rgwclgccll lplslslaaa kqllryrlae egpadvrign vasdlgivtg
  61 sgevtfsles gseylkidnl tgelststserr idreklpqcq mifdenecfl dfevsvigps
 121 qswvdlfegq vivldindnt ptfpspvltl tveenrpvgt lyllptatdr dfgrngiery
 181 ellqepgggg sggesrraga adsapypggg gngasgggsg gskrrldase ggggtnpggr
 241 ssvfelqvad tpdgekqpql ivkgaldreq rdsyeltlrv rdggdpprss qailrvlitd
 301 vndnsprfek svyeadlaen sapgtpilql raadldvgvn gqieyvfgaa tesvrrllrl
 361 detsgwlsvl hridreevnq lrftvmardr gqppktdkat vvlnikdend nvpsieirki
 421 griplkdgva nvaedvlvdt pialvqvsdr dqgengvvtc tvvgdvpfql kpasdtegdq
 481 nkkkyflhts tpldyeatre fnvvivavds gspslssnns livkvgdtnd nppmfgqsvv
 541 evyfpennip gervatvlat dadsgknaei aysldssvmg ifaidpdsgd ilvntvldre
 601 qtdryefkvn akdkgipvlq gsttvivqva dkndndpkfm qdvftfyvke nlqpnspvgm
 661 vtvmdadkgr naemslyiee nnnifsiend tgtiystmsf drehqttytf rvkavdggdp
 721 prsatatvsl fvmdendnap tvtlpknisy tllppssnvr tvvatvlatd sddginadln
 781 ysivggnpfk lfeidptsgv vslvgkltqk hyglhrlvvq vndsgqpsqs ttttlvhvfvn
 841 esvsnataid sqiarslhip ltqdiagdps yeiskqrlsi vigvvagimt viliilivvm
 901 arycrsknkn gyeagkkdhe dfftpqqhdk skkpkkdkkn kkskqplyss ivtveaskpn
 961 gqrydsvnek lsdspsmgry rsvnggpgsp dlarhyksss plptvqlhpq sptagkkhqa
1021 vqdlppantf vgagdnisig sdhcseyscq tnnkyskqpf lhpyitvfg
```

Protein sequence isoform c (SEQ ID NO (13)):
```
   1 mlrmrtagwa rgwclgccll lplslslaaa kqllryrlae egpadvrign vasdlgivtg
  61 sgevtfsles gseylkidnl tgelststserr idreklpqcq mifdenecfl dfevsvigps
 121 qswvdlfegq vivldindnt ptfpspvltl tveenrpvgt lyllptatdr dfgrngiery
 181 ellqepgggg sggesrraga adsapypggg gngasgggsg gskrrldase ggggtnpggr
 241 ssvfelqvad tpdgekqpql ivkgaldreq rdsyeltlrv rdggdpprss qailrvlitd
 301 vndnsprfek svyeadlaen sapgtpilql raadldvgvn gqieyvfgaa tesvrrllrl
 361 detsgwlsvl hridreevnq lrftvmardr gqppktdkat vvlnikdend nvpsieirki
 421 griplkdgva nvaedvlvdt pialvqvsdr dqgengvvtc tvvgdvpfql kpasdtegdq
 481 nkkkyflhts tpldyeatre fnvvivavds gspslssnns livkvgdtnd nppmfgqsvv
 541 evyfpennip gervatvlat dadsgknaei aysldssvmg ifaidpdsgd ilvntvldre
 601 qtdryefkvn akdkgipvlq gsttvivqva dkndndpkfm qdvftfyvke nlqpnspvgm
 661 vtvmdadkgr naemslyiee nnnifsiend tgtiystmsf drehqttytf rvkavdggdp
 721 prsatatvsl fvmdendnap tvtlpknisy tllppssnvr tvvatvlatd sddginadln
 781 ysivggnpfk lfeidptsgv vslvgkltqk hyglhrlvvq vndsgqpsqs ttttlvhvfvn
 841 esvsnataid sqiarslhip ltqdiagdps yeiskqrlsi vigvvagimt viliilivvm
 901 arycrsknkn gyeagkkdhe dfftpqqhdk skkpkkdkkn kkskqplyss ivtveaskpn
 961 gqrydsvnek lsdspsmgry rsvnggpgsp dlarhyksss plptvqlhpq sptagkkhqa
1021 vqdlppantf vgagdnisig sdhcseyscq tnnkyskqpf rrvtfsvvsq pqdphqgslq
1081 scydsglees etpssksssg prlgalplpe dnyerttpdg svdsrplpdv altgkctrec
1141 deyghsdscw mpvrtsperk ksqpklstfm pvdergsqek langeaaimg drnrnllnkk
1201 ltssyetfsa asfskneean pedipltktg eykpspvntl trrevyl
```

Protein sequence isoform d (SEQ ID NO (14)):
```
   1 mlrmrtagwa rgwclgccll lplslslaaa kqllryrlae egpadvrign vasdlgivtg
  61 sgevtfsles gseylkidnl tgelststserr idreklpqcq mifdenecfl dfevsvigps
 121 qswvdlfegq vivldindnt ptfpspvltl tveenrpvgt lyllptatdr dfgrngiery
 181 ellqepgggg sggesrraga adsapypggg gngasgggsg gskrrldase ggggtnpggr
 241 ssvfelqvad tpdgekqpql ivkgaldreq rdsyeltlrv rdggdpprss qailrvlitd
 301 vndnsprfek svyeadlaen sapgtpilql raadldvgvn gqieyvfgaa tesvrrllrl
 361 detsgwlsvl hridreevnq lrftvmardr gqppktdkat vvlnikdend nvpsieirki
 421 griplkdgva nvaedvlvdt pialvqvsdr dqgengvvtc tvvgdvpfql kpasdtegdq
 481 nkkkyflhts tpldyeatre fnvvivavds gspslssnns livkvgdtnd nppmfgqsvv
 541 evyfpennip gervatvlat dadsgknaei aysldssvmg ifaidpdsgd ilvntvldre
 601 qtdryefkvn akdkgipvlq gsttvivqva dkndndpkfm qdvftfyvke nlqpnspvgm
 661 vtvmdadkgr naemslyiee nnnifsiend tgtiystmsf drehqttytf rvkavdggdp
 721 prsatatvsl fvmdendnap tvtlpknisy tllppssnvr tvvatvlatd sddginadln
 781 ysivggnpfk lfeidptsgv vslvgkltqk hyglhrlvvq vndsgqpsqs ttttlvhvfvn
 841 esvsnataid sqiarslhip ltqdiagdps yeiskqrlsi vigvvagimt viliilivvm
 901 arycrsknkn gyeagkkdhe dfftpqqhdk skkpkkdkkn kkskqplyss ivtveaskpn
 961 gqrydsvnek lsdspsmgry rsvnggpgsp dlarhyksss plptvqlhpq sptagkkhqa
1021 vqdlppantf vgagdnisig sdhcseyscq tnnkyskqpf rrvtfsvvsq pqdphqgslq
1081 scydsglees etpssksssg prlgalplpe dnyerttpdg svgeaehmen dsrplpdval
1141 tgkctrecde yghsdscwmp vrtsperkks qpklstfmpv dergsqekla ngeaaimgdr
1201 nrnllnkklt ssyetfsaas fskneeanpe dipltktgey kpspvntltr revyl
```

Gene ID:
X8

TABLE 2-continued

Gene symbol:
NOG

Gene description:
noggin

Unigene:
Hs.248201

Genbank:
BC034027

Entrez Gene:
9241

Refseq:
NM_005450

Protein sequence (SEQ ID NO (15)):
```
  1 mercpslgvt lyalvvvlgl ratpaggqhy lhirpapsdn lplvdliehp dpifdpkekd
 61 lnetllrsll gghydpgfma tsppedrpgg gggaaggaed laeldqllrq rpsgampsei
121 kglefsegla qgkkqrlskk lrrklqmwlw sqtfcpvlya wndlgsrfwp ryvkvgscfs
181 krscsvpegm vckpsksvhl tvlrwrcqrr gggrcgwipi qypiiseckc sc
```

Gene ID:
X9

Gene symbol:
SULF1

Gene description:
sulfatase 1

Unigene:
Hs.409602

Genbank:
AF545571

Entrez Gene:
23213

Refseq:
NM_001128205|NM_015170|NM_001128206|NM_001128204

Protein sequence (SEQ ID NO (16)):
```
  1 mkysccalvl avlgtellgs lcstvrsprf rgriqqerkn irpniilvlt ddqdvelgsl
 61 qvmnktrkim ehggatfina fvttpmccps rssmltgkyv hnhnvytnne ncsspswqam
121 heprtfavyl nntgyrtaff gkylneyngs yippgwrewl gliknsrfyn ytvcrngike
181 khgfdyakdy ftdlitnesi nyfkmskrmy phrpvmmvis haaphgpeds apqfsklypn
241 asqhitpsyn yapnmdkhwi mqytgpmlpi hmeftnilqr krlqtlmsvd dsverlynml
301 vetgelenty iiytadhgyh igqfglvkgk smpydfdirv pffirgpsve pgsivpqivl
361 nidlaptild iagldtppdv dgksvlklld pekpgnrfrt nkkakiwrdt flvergkflr
421 kkeesskniq qsnhlpkyer vkelcqqary qtaceqpgqk wqciedtsgk lrihkckgps
481 dlltvrqstr nlyargfhdk dkecscresg yrasrsqrks qrqflrnqgt pkykprfvht
541 rqtrslsvef egeiydinle eeeelqvlqp rniakrhdeg hkgprdlqas sggnrgrmla
601 dssnavgppt tvrvthkcfi lpndsihcer elyqsarawk dhkayidkei ealqdkiknl
661 revrghlkrr kpeecscskq syynkekgvk kqeklkshlh pfkeaaqevd sklqlfkenn
721 rrrkkerkek rrqrkgeecs lpgltcfthd nnhwqtapfw nlgsfcacts snnntywclr
781 tvnethnflf cefatgfley fdmntdpyql tntvhtverg ilnqlhvqlm elrscqgykq
841 cnprpknldv gnkdggsydl hrgqlwdgwe g
```

Gene ID:
X10

Gene symbol:
SORT1

Gene description:
sortilin 1

Unigene:
Hs.485195

Genbank:
X98248

Entrez Gene:
6272

TABLE 2-continued

Refseq:
NM_002959|NM_001205228

Protein sequence isoform 1 (SEQ ID NO (17)):
```
    1 merpwgaadg lsrwphglgl llllqllpps tlsqdrldap pppaaplprw sgpigvswgl
   61 raaaaggafp rggrwrrsap gedeecgrvr dfvaklannt hqhvfddlrg svslswvgds
  121 tgvilvlttf hvplvimtfg qsklyrsedy gknfkditdl inntfirtef gmaigpensg
  181 kvvltaevsg gsrggrifrs sdfaknfvqt dlpfhpltqm myspqnsdyl lalstenglw
  241 vsknfggkwe eihkavclak wgsdntifft tyangsckad lgalelwrts dlgksfktig
  301 vkiysfglgg rflfasvmad kdttrrihvs tdqgdtwsma qlpsvgqeqf ysilaanddm
  361 vfmhvdepgd tgfgtiftsd drgivysksl drhlytttgg etdftnvtsl rgvyitsvls
  421 ednsiqtmit fdqggrwthl rkpensecda taknknecsl hihasysisq klnvpmapls
  481 epnavgivia hgsvgdaisv mvpdvyisdd ggyswtkmle gphyytilds ggiivaiehs
  541 srpinvikfs tdegqcwqty tftrdpiyft glasepgars mnisiwgfte sfltsqwvsy
  601 tidfkdiler nceekdytiw lahstdpedy edgcilgyke qflrlrkssv cqngrdyvvt
  661 kqpsiclcsl edflcdfgyy rpendskcve qpelkghdle fclygreehl ttngyrkipg
  721 dkcqggvnpv revkdlkkkc tsnflspekq nsksnsvpii laivglmlvt vvagvlivkk
  781 yvcggrflvh rysvlqqhae angvdgvdal dtashtnksg yhddsdedll e
```

Protein sequence isoform 2 (SEQ ID NO (18)):
```
    1 mtfgqsklyr sedygknfkd itdlinntfi rtefgmaigp ensgkvvlta evsggsrggr
   61 ifrssdfakn fvqtdlpfhp ltqmmyspqn sdyllalste nglwvsknfg gkweeihkav
  121 clakwgsdnt ifftttyangs ctdlgalelw rtsdlgksfk tigvkiysfg lggrflfasv
  181 madkdttrri hvstdqgdtw smaqlpsvgq eqfysilaan ddmvfmhvde pgdtgfgtif
  241 tsddrgivys ksldrhlytt tggetdftnv tslrgvyits vlsednsiqt mitfdqggrw
  301 thlrkpense cdataknkne cslhihasys isqklnvpma plsepnavgi viahgsvgda
  361 isvmvpdvyi sddggyswtk mlegphyyti ldsggiivai ehssrpinvi kfstdegqcw
  421 qtytftrdpi yftglasepg arsmnisiwg ftesfltsqw vsytidfkdi lernceekdy
  481 tiwlahstdp edyedgcilg ykeqflrlrk ssvcqngrdy vvtkqpsicl csledflcdf
  541 gyyrpendsk cveqpelkgh dlefclygre ehlttngyrk ipgdkcqggv npvrevkdlk
  601 kkctsnflsp ekqnsksnsv piilaivglm lvtvvagvli vkkyvcggrf lvhrysvlqq
  661 haeangvdgv daldtashtn ksgyhddsde dlle
```

Gene ID:
X11

Gene symbol:
ATP1B1

Gene description:
sodium/potassium-transporting ATPase subunit beta-1

Unigene:
Hs.291196

Genbank:
U16799

Entrez Gene:
481

Refseq:
NM_001677

Protein sequence (SEQ ID NO (19)):
```
    1 margkakeeg swkkfiwnse kkeflgrtgg swfkillfyv ifygclagif igtiqvmllt
   61 isefkptyqd rvappgltqi pqiqkteisf rpndpksyea yvlnivrfle kykdsaqrdd
  121 mifedcgdvp sepkergdfn hergerkvcr fklewlgncs glndetygyk egkpciiikl
  181 nrvlgfkpkp pknesletyp vmkynpnvlp vqctgkrded kdkvgnveyf glgnspgfpl
  241 qyypyygkll qpkylqplla vqftnltmdt eirieckayg enigysekdr fqgrfdvkie
  301 vks
```

Gene ID:
X12

Gene symbol:
AGRN

Gene description:
Agrin

Unigene:
Hs.273330

Genbank:
AB191264

Entrez Gene:
375790

TABLE 2-continued

Refseq:
NM_198576

Protein sequence (SEQ ID NO (20)):
```
   1 magrshpgpl rpllpllvva acvlpgaggt cperalrerre eeanvvltgt veeilnvdpv
  61 qhtysckvrv wrylkgkdlv areslldggn kvvisgfgdp licdnqvstg dtriffvnpa
 121 ppylwpahkn elmlnsslmr itlrnleeve fcvedkpgth ftpvpptppd acrgmlcgfg
 181 avcepnaegp grascvckks pcpsvvapvc gsdastysne celqraqcsq qrrirllsrg
 241 pcgsrdpcsn vtcsfgstca rsadgltasc lcpatcrgap egtvcgsdga dypgecqllr
 301 racarqenvf kkfdgpcdpc qgalpdpsrs crvnprtrrp emllrpescp arqapvcgdd
 361 gvtyendcvm grsgaargll lqkvrsgqcq grdqcpepcr fnavclsrrg rprcscdrvt
 421 cdgayrpvca qdgrtydsdc wrqqaecrqq raipskhqgp cdqapspclg vqcafgatca
 481 vkngqaacec lqacsslydp vcgsdgvtyg saceleatac tlgreiqvar kgpcdrcgqc
 541 rfgalceaet grcvcpsecv alaqpvcgsd ghtypsecml hvhacthqis lhvasagpce
 601 tcgdavcafg avcsagqcvc prcehpppgp vcgsdgvtyg sacelreaac lqqtqieeear
 661 agpceqaecg sggsgsgedg dceqelcrqr ggiwdedsed gpcvcdfscq svpgspvcgs
 721 dgvtystece lkkarcesqr glyvaaqgac rgptfaplpp vaplhcaqtp ygccqdnita
 781 argvglagcp sacqcnphgs yggtcdpatg qcscrpgvgg lrcdrcepgf wnfrgivtdg
 841 rsgctpcscd pqgavrddce qmtglcsckp gvagpkcgqc pdgralgpag ceadasapat
 901 caemrcefga rcveesgsah cvcpmltcpe anatkvcgsd gvtygnecql ktiacrqglq
 961 isiqslgpcq eavapsthpt sasvtvttpg lllsqalpap pgalplapss tahsqttppp
1021 ssrprttasv prttvwpvlt vpptapspap slvasafges gstdgssdee lsgdqeasgg
1081 gsggleplegeg ssvatpgppv erascynsal gccsdgktps ldaegsncpa tkvfqgvlel
1141 egvegqelfy tpemadpkse lfgetarsie stlddlfrns dvkkdfrsvr lrdlgpgksv
1201 raivdvhfdp ttafrapdva rallrqiqvs rrrslgvrrp lqehvrfmdf dwfpafitga
1261 tsgaiaagat arattasrlp ssavtpraph pshtsqpvak ttaapttrrp pttapsrvpg
1321 rrppapqqpp kpcdsqpcfh ggtcqdwalg ggftcscpag rggavcekvl gapvpafegr
1381 sflafptlra yhtlrlalef ralepqglll yngnargkdf lalalldgrv qlrfdtgsgp
1441 avltsavpve pgqwhrlels rhwrrgtlsv dgetpvlges psgtdglnld tdlfvggvpe
1501 dqaavalert fvgaglrgci rllldvnnqrl elgigpgaat rgsgvgecgd hpclpnpchg
1561 gapcqnleag rfhcqcppgr vgptcadeks pcqnpchga apervlpegg aqcecplgre
1621 gtfcqtasgq dgsgpfladf ngfshlelrg lhtfardlge kmalevvfla rgpsglllyn
1681 gqktdgkgdf vslalrdrrl efrydlgkga avirsrepvt lgawtrvsle rngrkgalrv
1741 gdgprvlges pvphtvlnlk eplyvggapd fsklaraaav ssgfdgaiql vslggrqllt
1801 pehvlrqvdv tsfaghpctr asghpclnga scvpreaayv clcpggfsgp hcekglveks
1861 agdvdtlafd grtfveylna vtesekalqs nhfelslrte atqglvlwsg kateradyva
1921 laivdghlql synlgsqpvv lrstvpvntn rwlrvvahre qregslqvgn eapvtgsspl
1981 gatqldtdga lwlgglpelp vgpalpkayg tgfvgclrdv vvgrhplhll edavtkpelr
2041 pcptp
```

Gene ID:
X13

Gene symbol:
APP

Gene description:
Amyloid beta A4 protein

Unigene:
Hs.434980

Genbank:
BC065529|AF282245|AK298861|AK294534|AK295621|AK296229|AK297412|
AK297229|AK295373|BC004369|M16765|AK311717

Entrez Gene:
351

Refseq:
NM_000484|NM_201413|NM_001136130|NM_201414|NM_001136129

Protein sequence isoform a (SEQ ID NO (21)):
```
   1 mlpglallll aawtaralev ptdgnaglla epqiamfcgr lnmhmnvqng kwdsdpsgtk
  61 tcidtkegil qycqevypel qitnvveanq pvtiqnwckr grkqckthph fvipyrclvg
 121 efvsdallvp dkckflhqer mdvcethlhw htvaketcse kstnlhdygm llpcgidkfr
 181 gvefvccpla eesdnvdsad aeeddsdvww ggadtdyadg sedkvveae eeevaeveee
 241 eadddedded gdeveeeaee pyeeatertt siattttttt esveevvrev cseqaetgpc
 301 ramisrwyfd vtegkcapff yggcggnrnn fdteeycmav cgsamsqsll kttqeplard
 361 pvklpttaas tpdavdkyle tpgdenehah fqkakerlea khrermsqvm reweeaerqa
 421 knlpkadkka viqhfqekve sleqeaaner qqlvethmar veamlndrrr lalenyital
 481 qavpprprhv fnmlkkyvra eqkdrqhtlk hfehvrmvdp kkaaqirsqv mthlrviyer
 541 mnqslsllyn vpavaeeiqd evdellqkeq nysddvlanm iseprisygn dalmpsltet
 601 kttvellpvn gefsldddlqp whsfgadsvp anteneveypv darpaadrgl ttrpgsgltn
 661 ikteeisevk mdaefrhdsg yevhhqklvf faedvgsnkg aiiglmvggv viatvivitl
 721 vmlkkkqyts ihhgvvevda avtpeerhls kmqqngyenp tykffeqmqn
```

Protein sequence isoform b (SEQ ID NO (22)):
```
   1 mlpglallll aawtaralev ptdgnaglla epqiamfcgr lnmhmnvqng kwdsdpsgtk
```

TABLE 2-continued

```
  61 tcidtkegil qycqevypel qitnvveanq pvtiqnwckr grkqckthph fvipyrclvg
 121 efvsdallvp dkckflhqer mdvcethlhw htvaketcse kstnlhdygm llpcgidkfr
 181 gvefvccpla eesdnvdsad aeeddsdvww ggadtdyadg sedkvvevae eeevaeveee
 241 eadddedged gdeveeeaee pyeeatertt siattttttt esveevvrev cseqaetgpc
 301 ramisrwyfd vtegkcapff yggcggnrnn fdteeycmav cgsaipttaa stpdavdkyl
 361 etpgdeneha hfqkakerle akhrermsqv mreweeaerq aknlpkadkk aviqhfqekv
 421 esleqeaane rqqlvethma rveamlndrr rlalenyita lqavpprprh vfnmlkkyvr
 481 aeqkdrqhtl khfehvrmvd pkkaaqirsq vmthlrviye rmnqslslly nvpavaeeiq
 541 devdellqke qnysddvlan miseprisyg ndalmpslte tkttvellpv ngefslddlq
 601 pwhsfgadsv pantenevep vdarpaadrg lttrpgsglt nikteeisev kmdaefrhds
 661 gyevhhqklv ffaedvgsnk gaiiglmvgg vviatvivit lvmlkkkqyt sihhgvvevd
 721 aavtpeerhl skmqqngyen ptykffeqmq n
```

Protein sequence isoform f (SEQ ID NO (23)):
```
   1 mlpglalll1 aawtaralev ypelqitnvv eanqpvtiqn wckrgrkqck thphfvipyr
  61 clvgefvsda llvpdkckfl hqermdvcet hlhwhtvake tcseksnlnh dygmllpcgi
 121 dkfrgvefvc cplaeesdnv dsadaeedds dvwwggadtd yadgsedkvv evaeeeevae
 181 veeeeaddde ddedgdevee eaeepyeeat erttsiattt ttttesveev vrevcseqae
 241 tgperamisr wyfdvtegkc apffyggcgg nrnnfdteey cmavcgsams qsllkttqep
 301 lardpvklpt taastpdavd kyletpgden ehahfqkake rleakhrerm sqvmreweea
 361 erqaknlpka dkkaviqhfq ekvesleqea anerqqlvet hmarveamin drrrlaleny
 421 italqavppr prhvfnmlkk yvraeqkdrq htlkhfehvr mvdpkkaaqi rsqvmthlrv
 481 iyermnqsls llynvpavae eiqdevdell qkeqnysddv lanmisepri sygndalmps
 541 ltetkttvel lpvngefsld dlqpwhsfga dsvpantene vepvdarpaa drglttrpgs
 601 gltnikteei sevkmdaefr hdsgyevhhq klvffaedvg snkgaiiglm vggvviatvi
 661 vitlvmlkkk qytsihhgvv evdaavtpee rhlskmqqng yenptykffe qmqn
```

Protein sequence isoform c (SEQ ID NO (24)):
```
   1 mlpglalll1 aawtaralev ptdgnaglla epqiamfcgr lnmhmnvqng kwdsdpsgtk
  61 tcidtkegil qycqevypel qitnvveanq pvtiqnwckr grkqckthph fvipyrclvg
 121 efvsdallvp dkckflhqer mdvcethlhw htvaketcse kstnlhdygm llpcgidkfr
 181 gvefvccpla eesdnvdsad aeeddsdvww ggadtdyadg sedkvvevae eeevaeveee
 241 eadddedged gdeveeeaee pyeeatertt siattttttt esveevvrvp ttaastpdav
 301 dkyletpgde nehahfqkak erleakhrer msqvmrewee aerqaknlpk adkkaviqhf
 361 qekvesleqe aanerqqlve thmarveaml ndrrrlalen yitalqavpp rprhvfnmlk
 421 kyvraeqkdr qhtlkhfehv rmvdpkkaaq irsqvmthlr viyermnqsl sllynvpava
 481 eeiqdevdel lqkeqnysdd vlanmisepr isygndalmp sltetkttve llpvngefsl
 541 ddlqpwhsfg adsvpanten evepvdarpa adrglttrpg sgltniktee isevkmdaef
 601 rhdsgyevhh qklvffaedv gsnkgaiigl mvggvviatv ivitlvmlkk kqytsihhgv
 661 vevdaavtpe erhlskmqqn gyenptykff eqmqn
```

Protein sequence isoform e (SEQ ID NO (25)):
```
   1 mlpglalll1 aawtaralev ypelqitnvv eanqpvtiqn wckrgrkqck thphfvipyr
  61 clvgefvsda llvpdkckfl hqermdvcet hlhwhtvake tcseksnlnh dygmllpcgi
 121 dkfrgvefvc cplaeesdnv dsadaeedds dvwwggadtd yadgsedkvv evaeeeevae
 181 veeeeaddde ddedgdevee eaeepyeeat erttsiattt ttttesveev vrvpttaast
 241 pdavdkylet pgdenehahf qkakerleak hrermsqvmr eweeaerqak nlpkadkkav
 301 iqhfqekves leqeaanerq qlvethmarv eamlndrrrl alenyitalq avpprprhvf
 361 nmlkkyvrae qkdrqhtlkh fehvrmvdpk kaaqirsqvm thlrviyerm nqslsllynv
 421 pavaeeiqde vdellqkeqn ysddvlanmi seprisygnd almpsltetk ttvellpvng
 481 efslddlqpw hsfgadsvpa ntenevepvd arpaadrglt trpgsgltni kteeisevkm
 541 daefrhdsgy evhhqklvff aedvgsnkga iiglmvggvv iatvivitlv mlkkkqytsi
 601 hhgvvevdaa vtpeerhlsk mqqngyenpt ykffeqmqn
```

Gene ID:
X14

Gene symbol:
COLEC12

Gene description:
Collectin sub-family member 12

Unigene:
Hs.464422

Genbank:
AB038518

Entrez Gene:
81035

Refseq:
NM_130386

Protein sequence (SEQ ID NO (26)):
```
   1 mkddfaeeee vqsfgykrfg iqegtqctkc knnwalkfsi illyilcall titvailgyk
  61 vvekmdnvtg gmetsrqtyd dkltavesdl kklgdqtgkk aistnselst frsdildlrq
 121 qlreitekts knkdtleklq asgdalvdrq sqlketlenn sflittvnkt lqayngyvtn
 181 lqqdtsvlqg nlqnqmyshn vvimnlnnln ltqvqqrnli tnlqrsvddt sqaiqrikhd
```

TABLE 2-continued

```
241 fqnlqqvflq akkdtdwlke kvqslqtlaa nnsalakann dtledmnsql nsftgqmeni
301 ttisqaneqn lkdlqdlhkd aenrtaikfn qleerfqlfe tdivniisni sytahhlrtl
361 tsnlnevrtt ctdtltkhtd dltslnntla nirldsvslr mqqdlmrsrl dtevanlsvi
421 meemklvdsk hgqliknfti lqgppgprgp rgdrgsqgpp gptgnkgqkg ekgepgppgp
481 agergpigpa gppgerggkg skgsqgpkgs rgspgkpgpq gpsgdpgppg ppgkeglpgp
541 qgppgfqglq gtvgepgvpg prglpglpgv pgmpgpkgpp gppgpsgavv plalqneptp
601 apedngcpph wknftdkcyy fsvekeifed aklfcedkss hlvfintree qqwikkqmvg
661 reshwigltd serenewkwl dgtspdyknw kagqpdnwgh ghgpgedcag liyagqwndf
721 qcedvnnfic ekdretvlss al
```

Gene ID:
X15

Gene symbol:
NCAM1

Gene description:
Neural cell adhesion molecule 1

Unigene:
Hs.503878

Genbank:
BC047244

Entrez Gene:
4684

Refseq:
NM_000615|NM_001076682|NM_181351|NM_001242608|NM_001242607

Protein sequence isoform 1 (SEQ ID NO (27)):
```
  1 mlqtkdliwt lfflgtaysl qvdivpsqge isvgeskffl cqvagdakdk diswfspnge
 61 kltpnqqris vvwnddssst ltiynanidd agiykcvvtg edgeseeatv nvkifqklmf
121 knaptpqefr egedavivcd vvsslpptii wkhkgrdvil kkdvrfivls nnylqirgik
181 ktdegtyrce grilargein fkdiqvivnv pptiqarqni vnatanlgqs vtlvcdaegf
241 peptmswtkd geqieqeedd ekyifsddss qltikkvdkn deaeyiciae nkageqdati
301 hlkvfakpki tyvenqtame leeqvtltce asgdpipsit wrtstrniss eektldghmv
361 vrsharvssl tlksiqytda geyictasnt igqdsqsmyl evqyapklqg pvavytwegn
421 qvnitcevfa ypsatiswfr dgqllpssny snikiyntps asylevtpds endfgnynct
481 avnrigqesl efilvqadtp sspsidqvep ysstaqvqfd epeatggvpi lkykaewrav
541 geevwhskwy dakeasmegi vtivglkpet tyavrlaaln gkglgeisaa sefktqpvqg
601 epsapklegq mgedgnsikv nlikqddggs pirhylvryr alssewkpei rlpsgsdhvm
661 lksldwnaey evyvvaenqq gkskaahfvf rtsaqptaip angsptsgls tgaivgiliv
721 ifvllllvvvd itcyflnkcg lfmciavnlc gkagpgakgk dmeegkaafs kdeskepive
781 vrteeertpn hdggkhtepn ettpltepek gpveakpecq etetkpapae vktvpndatq
841 tkeneska
```

Protein sequence isoform 3 (SEQ ID NO (28)):
```
  1 mlqtkdliwt lfflgtaysl qvdivpsqge isvgeskffl cqvagdakdk diswfspnge
 61 kltpnqqris vvwnddssst ltiynanidd agiykcvvtg edgeseeatv nvkifqklmf
121 knaptpqefr egedavivcd vvsslpptii wkhkgrdvil kkdvrfivls nnylqirgik
181 ktdegtyrce grilargein fkdiqvivnv pptiqarqni vnatanlgqs vtlvcdaegf
241 peptmswtkd geqieqeedd ekyifsddss qltikkvdkn deaeyiciae nkageqdati
301 hlkvfakpki tyvenqtame leeqvtltce asgdpipsit wrtstrniss eektldghmv
361 vrsharvssl tlksiqytda geyictasnt igqdsqsmyl evqyapklqg pvavytwegn
421 qvnitcevfa ypsatiswfr dgqllpssny snikiyntps asylevtpds endfgnynct
481 avnrigqesl efilvqadtp sspsidqvep ysstaqvqfd epeatggvpi lkykaewrav
541 geevwhskwy dakeasmegi vtivglkpet tyavrlaaln gkglgeisaa sefktqpvhs
601 ppppasasss tpvplsppdt twplpalatt epakgepsap klegqmgedg nsikvnlikq
661 ddggspirhy lvryralsse wkpeirlpsg sdhvmlksld wnaeyevyvv aenqqgkska
721 ahfvfrtsaq ptaipatlgg nsasytfvsl lfsavtlllll c
```

Protein sequence isoform 2 (SEQ ID NO (29)):
```
  1 mlqtkdliwt lfflgtaysl qvdivpsqge isvgeskffl cqvagdakdk diswfspnge
 61 kltpnqqris vvwnddssst ltiynanidd agiykcvvtg edgeseeatv nvkifqklmf
121 knaptpqefr egedavivcd vvsslpptii wkhkgrdvil kkdvrfivls nnylqirgik
181 ktdegtyrce grilargein fkdiqvivnv pptiqarqni vnatanlgqs vtlvcdaegf
241 peptmswtkd geqieqeedd ekyifsddss qltikkvdkn deaeyiciae nkageqdati
301 hlkvfakpki tyvenqtame leeqvtltce asgdpipsit wrtstrniss eekaswtrpe
361 kqetldghmv vrsharvssl tlksiqytda geyictasnt igqdsqsmyl evqyapklqg
421 pvavytwegn qvnitcevfa ypsatiswfr dgqllpssny snikiyntps asylevtpds
481 endfgnynct avnrigqesl efilvqadtp sspsidqvep ysstaqvqfd epeatggvpi
541 lkykaewrav geevwhskwy dakeasmegi vtivglkpet tyavrlaaln gkglgeisaa
601 sefktqpvqg epsapklegq mgedgnsikv nlikqddggs pirhylvryr alssewkpei
661 rlpsgsdhvm lksldwnaey evyvvaenqq gkskaahfvf rtsaqptaip angsptsgls
721 tgaivgiliv ifvllllvvvd itcyflnkcg lfmciavnlc gkagpgakgk dmeegkaafs
781 kdeskepive vrteeertpn hdggkhtepn ettpltepek gpveakpecq etetkpapae
841 vktvpndatq tkeneska
```

TABLE 2-continued

```
Protein sequence isoform 4 (SEQ ID NO (30)):
   1 mlqtkdliwt lfflgtaysl qvdivpsqge isvgeskffl cqvagdakdk diswfspnge
  61 kltpnqqris vvwnddssst ltiynanidd agiykcvvtg edgseseatv nvkifqklmf
 121 knaptpqefr egedavivcd vvsslpptii wkhkgrdvil kkdvrfivls nnylqirgik
 181 ktdegtyrce grilargein fkdiqvivnv pptiqarqni vnatanlgqs vtlvcdaegf
 241 peptmswtkd geqieqeedd ekyifsddss qltikkvdkn deaeyiciae nkageqdati
 301 hlkvfakpki tyvenqtame leeqvtltce asgdpipsit wrtstrniss eektldghmv
 361 vrsharvssl tlksiqytda geyictasnt igqdsqsmyl evqyapklqg pvavytwegn
 421 qvnitcevfa ypsatiswfr dgqllpssny snikiyntps asylevtpds endfgnynct
 481 avnriggesl efilvqadtp sspsidqvep ysstaqvqfd epeatggvpi lkykaewrav
 541 geevwhskwy dakeasmegi vtivglkpet tyavrlaaln gkglgeisaa sefktqpvqg
 601 epsapklegq mgedgnsikv nlikqddggs pirhylvryr alssewkpei rlpsgsdhvm
 661 lksldwnaey evyvvaenqq gkskaahfvf rtsaqptaip atlggnsasy tfvsllfsav
 721 tlllc Protein sequence isoform 5 (SEQ ID NO (31)):
   1 mlqtkdliwt lfflgtaysl qvdivpsqge isvgeskffl cqvagdakdk diswfspnge
  61 kltpnqqris vvwnddssst ltiynanidd agiykcvvtg edgseseatv nvkifqklmf
 121 knaptpqefr egedavivcd vvsslpptii wkhkgrdvil kkdvrfivls nnylqirgik
 181 ktdegtyrce grilargein fkdiqvivnv pptiqarqni vnatanlgqs vtlvcdaegf
 241 peptmswtkd geqieqeedd ekyifsddss qltikkvdkn deaeyiciae nkageqdati
 301 hlkvfakpki tyvenqtame leeqvtltce asgdpipsit wrtstrniss eekaswtrpe
 361 kqevhapwnw qvgrqkgqag sagfpgshet ldghmvvrsh arvssltlks iqytdageyi
 421 ctasntigqd sqsmylevqy apklqgpvav ytwegnqvni tcevfaypsa tiswfrdgql
 481 lpssnysnik iyntpsasyl evtpdsendf gnynctavnr vqqeslefil vqadtpssps
 541 idqvepysst aqvqfdepea tggvpilkyk aewravgeev whskwydake asmegivtiv
 601 glkpettyav rlaalngkgl geisaasefk tqpvqgepsa pklegqmged gnsikvnlik
 661 qddggspirh ylvryralss ewkpeirlps gsdhvmlksl dwnaeyevyv vaenqqgksk
 721 aahfvfrtsa qptaipangs ptsglstgai vgilivifvl llvvvditcy flnkcglfmc
 781 iavnlcgkag pgakgkdmee gkaafskdes kepivevrte eertpnhdgg khtepnettp
 841 ltepekgpve akpecqetet kpapaevktv pndatqtken eska Gene ID:
X16

Gene symbol:
NRP2

Gene description:
Neuropilin-2

Unigene:
Hs.471200

Genbank:
BX537423|AF016098|BC101525|BC104770|BC117413|BC143238|BC143608|
AF022860|AF280545|AF280544|AF022859|AK290934|AF280546|BC009222|
AL833606|BX648292|AK130198|BC018631

Entrez Gene:
8828

Refseq:
NM_201266|NM_003872|NM_201279|NM_018534|NM_201267|NM_201264

Protein sequence isoform 1 (SEQ ID NO (32)):
   1 mdmfpltwvf lalyfsrhqv rgqpdppcgg rlnskdagyi tspgypqdyp shqncewivy
  61 apepnqkivl nfnphfeiek hdckydfiei rdgdsesadl lgkhcgniap ptiissgsml
 121 yikftsdyar qgagfslrye ifktgsedcs knftspngti espgfpekyp hnldctftil
 181 akpkmeiilq flifdlehdp lqvgegdcky dwldiwdgip hvgpligkyc gtktpselrs
 241 stgilsltfh tdmavakdgf saryylvhqe plenfqcnvp lgmesgrian eqisasstys
 301 dgrwtpqqsr lhgddngwtp nldsnkeylq vdlrfltmlt aiatqgaisr etqngyyvks
 361 yklevstnge dwmvyrhgkn hkvfqannda tevvlnklha plltrfvrir pqtwhsgial
 421 rlelfgcrvt dapcsnmlgm lsgliadsqi sasstqeylw spsaarlvss rsgwfpripq
 481 aqpgeewlqv dlgtpktvkg viiqgarggd sitavearaf vrkfkvsysl ngkdweyiqd
 541 prtqqplkfe gnmhydtpdi rrfdpipaqy vrvyperwsp agigmrlevl gcdwtdskpt
 601 vetlgptvks eetttpypte eeatecgenc sfeddkqtlq psgfncnfdf leepcgwmyd
 661 hakwlrttwa sssspndrtf pddrnflrlq sdsqregqya rlisppvhlp rspvcmefqy
 721 qatggrgval qvvreasqes kllwviredq ggewkhgrii lpsydmeyqi vfegvigkgr
 781 sgeiaiddir istdvplenc mepisafage nfkvdipeih eregyedeid deyevdwsns
 841 ssatsgsgap stdkekswly tldpilitii amsslgvllg atcaglllyc tcsysglssr
 901 scttlenynf elydglkhkv kmnhqkccse a Protein sequence isoform 2 (SEQ ID NO (33)):
   1 mdmfpltwvf lalyfsrhqv rgqpdppcgg rlnskdagyi tspgypqdyp shqncewivy
  61 apepnqkivl nfnphfeiek hdckydfiei rdgdsesadl lgkhcgniap ptiissgsml
 121 yikftsdyar qgagfslrye ifktgsedcs knftspngti espgfpekyp hnldctftil
 181 akpkmeiilq flifdlehdp lqvgegdcky dwldiwdgip hvgpligkyc gtktpselrs
 241 stgilsltfh tdmavakdgf saryylvhqe plenfqcnvp lgmesgrian eqisasstys
 301 dgrwtpqqsr lhgddngwtp nldsnkeylq vdlrfltmlt aiatqgaisr etqngyyvks
```

TABLE 2-continued

```
  361 yklevstnge dwmvyrhgkn hkvfqannda tevvlnklha plltrfvrir pqtwhsgial
  421 rlelfgcrvt dapcsnmlgm lsgliadsqi sasstqeylw spsaarlvss rsgwfpripq
  481 aqpgeewlqv dlgtpktvkg viiqgarggd sitavearaf vrkfkvsysl ngkdweyiqd
  541 prtqqpklfe gnmhydtpdi rrfdpipaqy vrvyperwsp agigmrlevl gcdwtdskpt
  601 vetlgptvks eetttpypte eeatecgenc sfeddkdlql psgfncnfdf leepcgwmyd
  661 hakwlrttwa sssspndrtf pddrnflrlq sdsqregqya rlisppvhlp rspvcmefqy
  721 qatggrgval qvvreasqes kllwviredq ggewkhgrii lpsydmeyqi vfegvigkgr
  781 sgeiaiddir istdvplenc mepisafavd ipeiheregy edeiddeyev dwsnsssats
  841 gsgapstdke kswlytldpi litiiamssl gvllgatcag lllyctcsys glssrscttl
  901 enynfelydg lkhkvkmnhq kccsea Protein sequence isoform 3 (SEQ ID NO (34)):
    1 mdmfpltwvf lalyfsrhqv rgqpdppcgg rlnskdagyi tspgypqdyp shqncewivy
   61 apepnqkivl nfnphfeiek hdckydfiei rdgdsesadl lgkhcgniap ptiissgsml
  121 yikftsdyar qgagfslrye ifktgsedcs knftspngti espgfpekyp hnldctftil
  181 akpkmeiilq flifdlehdp lqvgegdcky dwldiwdgip hvgpligkyc gtktpselrs
  241 stgilsltfh tdmavakdgf saryylvhqe plenfqcnvp lgmesgrian eqisasstys
  301 dgrwtpqqsr lhgddngwtp nldsnkeylq vdlrfltmlt aiatqgaisr etqngyyvks
  361 yklevstnge dwmvyrhgkn hkvfqannda tevvlnklha plltrfvrir pqtwhsgial
  421 rlelfgcrvt dapcsnmlgm lsgliadsqi sasstqeylw spsaarlvss rsgwfpripq
  481 aqpgeewlqv dlgtpktvkg viiqgarggd sitavearaf vrkfkvsysl ngkdweyiqd
  541 prtqqpklfe gnmhydtpdi rrfdpipaqy vrvyperwsp agigmrlevl gcdwtdskpt
  601 vetlgptvks eetttpypte eeatecgenc sfeddkdlql psgfncnfdf leepcgwmyd
  661 hakwlrttwa sssspndrtf pddrnflrlq sdsqregqya rlisppvhlp rspvcmefqy
  721 qatggrgval qvvreasqes kllwviredq ggewkhgrii lpsydmeyqi vfegvigkgr
  781 sgeiaiddir istdvplenc mepisafade yevdwsnsss atsgsgapst dkekswlytl
  841 dpilitiiam sslgvllgat caglllyctc sysglssrsc ttlenynfel ydglkhkvkm
  901 nhqkccsea Protein sequence isoform 4 (SEQ ID NO (35)):
    1 mdmfpltwvf lalyfsrhqv rgqpdppcgg rlnskdagyi tspgypqdyp shqncewivy
   61 apepnqkivl nfnphfeiek hdckydfiei rdgdsesadl lgkhcgniap ptiissgsml
  121 yikftsdyar qgagfslrye ifktgsedcs knftspngti espgfpekyp hnldctftil
  181 akpkmeiilq flifdlehdp lqvgegdcky dwldiwdgip hvgpligkyc gtktpselrs
  241 stgilsltfh tdmavakdgf saryylvhqe plenfqcnvp lgmesgrian eqisasstys
  301 dgrwtpqqsr lhgddngwtp nldsnkeylq vdlrfltmlt aiatqgaisr etqngyyvks
  361 yklevstnge dwmvyrhgkn hkvfqannda tevvlnklha plltrfvrir pqtwhsgial
  421 rlelfgcrvt dapcsnmlgm lsgliadsqi sasstqeylw spsaarlvss rsgwfpripq
  481 aqpgeewlqv dlgtpktvkg viiqgarggd sitavearaf vrkfkvsysl ngkdweyiqd
  541 prtqqpklfe gnmhydtpdi rrfdpipaqy vrvyperwsp agigmrlevl gcdwtdskpt
  601 vetlgptvks eetttpypte eeatecgenc sfeddkdlql psgfncnfdf leepcgwmyd
  661 hakwlrttwa sssspndrtf pddrnflrlq sdsqregqya rlisppvhlp rspvcmefqy
  721 qatggrgval qvvreasqes kllwviredq ggewkhgrii lpsydmeyqi vfegvigkgr
  781 sgeiaiddir istdvplenc mepisafage nfkggtllpg teptvdtvpm qpipaywyyv
  841 maaggavlvl vsvalalvlh yhrfryaakk tdhsitykts hytngaplav eptltikleq
  901 drgshc Protein sequence isoform 5 (SEQ ID NO (36)):
    1 mdmfpltwvf lalyfsrhqv rgqpdppcgg rlnskdagyi tspgypqdyp shqncewivy
   61 apepnqkivl nfnphfeiek hdckydfiei rdgdsesadl lgkhcgniap ptiissgsml
  121 yikftsdyar qgagfslrye ifktgsedcs knftspngti espgfpekyp hnldctftil
  181 akpkmeiilq flifdlehdp lqvgegdcky dwldiwdgip hvgpligkyc gtktpselrs
  241 stgilsltfh tdmavakdgf saryylvhqe plenfqcnvp lgmesgrian eqisasstys
  301 dgrwtpqqsr lhgddngwtp nldsnkeylq vdlrfltmlt aiatqgaisr etqngyyvks
  361 yklevstnge dwmvyrhgkn hkvfqannda tevvlnklha plltrfvrir pqtwhsgial
  421 rlelfgcrvt dapcsnmlgm lsgliadsqi sasstqeylw spsaarlvss rsgwfpripq
  481 aqpgeewlqv dlgtpktvkg viiqgarggd sitavearaf vrkfkvsysl ngkdweyiqd
  541 prtqqpklfe gnmhydtpdi rrfdpipaqy vrvyperwsp agigmrlevl gcdwtdskpt
  601 vetlgptvks eetttpypte eeatecgenc sfeddkdlql psgfncnfdf leepcgwmyd
  661 hakwlrttwa sssspndrtf pddrnflrlq sdsqregqya rlisppvhlp rspvcmefqy
  721 qatggrgval qvvreasqes kllwviredq ggewkhgrii lpsydmeyqi vfegvigkgr
  781 sgeiaiddir istdvplenc mepisafagg tlllpgteptv dtvpmqpipa ywyyvmaagg
  841 avlvlvsval alvlhyhrfr yaakktdhsi tyktshytng aplaveptlt ikleqdrgsh
  901 c Protein sequence isoform 6 (SEQ ID NO (37)):
    1 mdmfpltwvf lalyfsrhqv rgqpdppcgg rlnskdagyi tspgypqdyp shqncewivy
   61 apepnqkivl nfnphfeiek hdckydfiei rdgdsesadl lgkhcgniap ptiissgsml
  121 yikftsdyar qgagfslrye ifktgsedcs knftspngti espgfpekyp hnldctftil
  181 akpkmeiilq flifdlehdp lqvgegdcky dwldiwdgip hvgpligkyc gtktpselrs
  241 stgilsltfh tdmavakdgf saryylvhqe plenfqcnvp lgmesgrian eqisasstys
  301 dgrwtpqqsr lhgddngwtp nldsnkeylq vdlrfltmlt aiatqgaisr etqngyyvks
  361 yklevstnge dwmvyrhgkn hkvfqannda tevvinklha plltrfvrir pqtwhsgial
  421 rlelfgcrvt dapcsnmlgm lsgliadsqi sasstqeylw spsaarlvss rsgwfpripq
  481 aqpgeewlqv dlgtpktvkg viiqgarggd sitavearaf vrkfkvsysl ngkdweyiqd
  541 prtqqpkvgc swrpl Gene ID:
X17
```

TABLE 2-continued

Gene symbol:
PLXNA2

Gene description:
Plexin-A2

Unigene:
Hs.497626

Genbank:
BC132676

Entrez Gene:
5362

Refseq:
NM_025179

Protein sequence (SEQ ID NO (38)):
```
   1 meqrrpwpra levdsrsvvl lsvvwvllap paagmpqfst fhsenrdwtf nhltvhqgtg
  61 avyvgainry ykltgnltiq vahktgpeed nkscyppliv qpcsevltlt nnvnklliid
 121 ysenrllacg slyqgvckll rlddlfilve pshkkehyls svnktgtmyg vivrsegedg
 181 klfigtavdg kqdyfptlss rklprdpess amldyelhsd fvsslikips dtlalvshfd
 241 ifyiygfasg gfvyfltvqp etpegvains agdlfytsri vrlckddpkf hsyvslpfgc
 301 tragveyrll qaaylakpgd slaqafnits qddvlfaifs kgqkqyhhpp ddsalcafpi
 361 rainlqiker lqscyqgegn lelnwllgkd vqctkapvpi ddnfcgldin qplggstpve
 421 gltlyttsrd rmtsvasyvy ngysvvfvgt ksgklkkira dgpphggvqy emvsvlkdgs
 481 pilrdmafsi dqrylyvmse rqvtrvpves ceqyttcgec lssgdphcgw calhnmcsrr
 541 dkcqqawepn rfaasisqcv slavhpssis vsehsrllsl vvsdapdlsa giacafgnlt
 601 evegqvsgsq vicispgpkd vpvipldqdw fglelqlrsk etgkifvste fkfyncsahq
 661 lclscvnsaf rchwckyrnl cthdpttcsf qegrinised cpqlvpteei lipvgevkpi
 721 tlkarnlpqp qsgqrgyecv lniqgaihry palrfnsssv qccnssyqyd gmdisnlavd
 781 favvwngnfi idnpqdlkvh lykcaagres cglclkadrk fecgwcsger rctlhqhcts
 841 psspwldwss hnvkcsnpqi teiltvsgpp eggtrvtihg vnlgldfsei ahhvqvagvp
 901 ctplpgeyii aeqivcemgh alvgttsgpv rlcigeckpe fmtkshqqyt fvnpsvlsln
 961 pirgpesggt mvtitghylg agssvavylg nqtcefygrs mseivcvspp ssnglgpvpv
1021 sysvdrahvd snlqfeyidd prvqriepew siasghtplt itgfnldviq eprirvkfng
1081 kesvnnckvv ntttltclap slttdyrpgl dtverpdefg fvfnnvqsll iyndtkfiyy
1141 pnptfellsp tgvldqkpgs piilkgknlc ppasggakln ytvligetpc avtvsetqll
1201 ceppnitgqh kvmvhvggmv fspgsysvis dslltlpaiv siaaggslll iiviivliay
1261 krksrendlt lkrlqmqmdn lesrvaleck eafaelqtdi neltsdldrs gipyldyrty
1321 amrvlfpgie dhpvlrelev qgngqqhvek alklfaqlin nkvflltfir tlelqrsfsm
1381 rdrgnvasli mtglqgrley atdvlkqlls dlidknlenk nhpklllrrt esvaekmltn
1441 wfafllhkfl kecageplfm lycaikqqme kgpidaitge aryslsedkl irqqieyktl
1501 ilncvnpdne nspeipvkvl ncdtitqvke kildavyknv pysqrpravd mdlewrqgri
1561 arvvlqdedi ttkiegdwkr lntlmhyqvs drsvvalvpk qtssynipas asisrtsisr
1621 ydssfrytgs pdslrsrapm itpdlesgvk vwhlvknhdh gdqkegdrgs kmvseiyltr
1681 llatkgtlqk fvddlfetlf stvhrgsalp laikymfdfl deqadrhsih dtvdrhtwks
1741 nclplrfwvn viknpqfvfd ihkgsitdac lsvvaqtfmd scstsehrlg kdspsnklly
1801 akdipsyksw veryyadiak lpaisdqdmn aylaeqsrlh avefnmlsal neiysyvsky
1861 seeligaleq deqarrqrla ykveqlinam sies
```

Gene ID:
X18

Gene symbol:
PCDHA4

Gene description:
Protocadherin alpha-4

Unigene:
Hs.199343

Genbank:
AF152482|AF152312

Entrez Gene:
56144

Refseq:
NM_018907|NM_031500

Protein sequence isoform 1 (SEQ ID NO (39)):
```
   1 mefswgsgqe srrlllllll laaweagngq lhysyseeak hgtfvgriaq dlglelaelv
  61 prlfrvaskg rggllevnlq ngilfvnsri dreelcrrsa ecsihleviv drplqvfhvd
 121 vevrdindnp pvfpatqknl siaesrplds rfplegasda digenallty rlspneyfsl
 181 ekppddelvk glglilrksl dreeapeifl vltatdggkp eltgtvqlli tvldandnap
 241 afdrtiykvr llenvpngtl viklnasdld eglngdivys fsndispnvk skfhidpitg
 301 qiivkgyidf eesksyeiiv egidkgqlpl sghcrvivev ednndnvpdl efkslslpir
```

TABLE 2-continued

```
 361 edaplgtvia lisysdkdmg vnglvtcslt shvpfklvst fknyyslvld saldresvsa
 421 yelvvtardg gspslwatas vsvevadvnd napafaqpey tvfvkennpp gchiftvsaw
 481 dadaqenalv syslverrvg eralssyvsv haesgkvyal qpldheelel lqfqvtarda
 541 gvpplgsnvt lqvfvldend napallapra ggtggaysel vpwsvgvghv vakvravdad
 601 sgynawlsye lqpgtggari pfrvglytge isttraldet daprhrllvl vkdhgepalt
 661 atatvlvslv esgqapkass ralvgavgpd aalvdvnvyl iiaicayssl lvltllllyta
 721 lrcsalpteg acapgkptlv cssavgswsy sqqrrprvcs gegppktdlm afspslpdsr
 781 dredqlqtte esfakprqpn pdwrysaslr agmhssvhle eagilragpg gpdqqwptvs
 841 satpepeage vsppvgagvn snswtfkygp gnpkqsgpge lpdkfiipgs paiisirqep
 901 tnsqidksdf itfgkkeetk kkkkkkkgnk tqekkekgns ttdnsdq Protein sequence isoform 2 (SEQ ID NO (40)):
   1 mefswgsgqe srrllllll laaweagngq lhysyseeak hgtfvgriaq dlglelaelv
  61 prlfrvaskg rggllevnlq ngilfvnsri dreelcrrsa ecsihleviv drplqvfhvd
 121 vevrdindnp pvfpatqknl siaesrplds rfplegasda digenallty rlspneyfsl
 181 ekppddelvk glglilrksl dreeapeifl vltatdggkp eltgtvqlli tvldandnap
 241 afdrtiykvr llenvpngtl viklnasdld eglngdivys fsndispnvk skfhidpitg
 301 qiivkgyidf eesksyeiiv egidkgqlpl sghcrvivev ednndnvpdl efkslslpir
 361 edaplgtvia lisysdkdmg vnglvtcslt shvpfklvst fknyyslvld saldresysa
 421 yelvvtardg gspslwatas vsvevadvnd napafaqpey tvfvkennpp gchiftvsaw
 481 dadaqenalv syslverrvg eralssyvsv haesgkvyal qpldheelel lqfqvtarda
 541 gvpplgsnvt lqvfvldend napallapra ggtggaysel vpwsvgvghv vakvravdad
 601 sgynawlsye lqpgtggari pfrvglytge isttraldet daprhrllvl vkdhgepalt
 661 atatvlvslv esgqapkass ralvgavgpd aalvdvnvyl iiaicayssl lvltllllyta
 721 lrcsalpteg acapgkptlv cssavgswsy sqqrrprvcs gegppktdlm afspslpdsr
 781 dredqlqtte esfakvsv
```

Gene ID:
X19

Gene symbol:
PCDHAC2

Gene description:
Protocadherin alpha-C2

Unigene:
Hs.199343

Genbank:
AF152304

Entrez Gene:
56134

Refseq:
NM_018899|NM_031883

```
Protein sequence isoform 1 (SEQ ID NO (41)):
   1 meqagtrpaa tehprlrrpm pwllllplll llllllpgpa asqlrysvpe eqapgalvgn
  61 varalglelr rlgpgclrin hlgapspryl eldltsgalf vneridreal ceqrprclls
 121 levlahnpva vsaveveild indnsprfpr pnyqlqvses vapgarfhie saqdpdvgan
 181 svqtyelsps ehfeldlkpl qenskvlelv lrkgldreqa alhhlvltav dggiparsgt
 241 aqisvrvldt ndnspafdqs tyrvqlreds ppgtlvvkln asdpdegsng elrysissyt
 301 sdrerqlfsi dastgevrvi ggldyeeass yqiyvqatdr gpvpmaghck vlvdivdvnd
 361 napevvltdl yspvpenatp ntivavlsvn dqdsgpnrkv slgleatlpf rlngfgnsyt
 421 lvvsgpldre rvavynitvt atdggipqlt slrtlkveis dindnppsfl edsysiyiqe
 481 nnlpgvllct vqatdpdeke naevtyslle reiqglpvts yvsinsasgs lyavnsfdye
 541 kfreffvtve aqdkgsppls stvtanvyvv dmndhaphil yptstnssaa femvprtapa
 601 gylvtkviam dsdsgqnawl fyhlaqtsdl dlfkvelhtg eirttrkmgd esgstfnltv
 661 vvrdngepsl sasvaitvav vdrvskilpd tqrhvksprt yseitlylii alstvsfifl
 721 ltiiilsiik cyrytaygta ccggfcgvre rspaelykqa nnnidariph glkvqphfie
 781 vrgngsltkt ycykacltag sgsdtfmfyn tgaqtgpgps gaqaavtdsr nitgqsgqna
 841 gnliilknea vsqneprqpn pdwrysaslr agmhssvhle eagilragpg gpdqqwptvs
 901 satpepeage vsppvgagvn snswtfkygp gnpkqsgpge lpdkfiipgs paiisirqep
 961 tnsqidksdf itfgkkeetk kkkkkkkgnk tqekkekgns ttdnsdq Protein sequence isoform 2 (SEQ ID NO (42)):
   1 meqagtrpaa tehprlrrpm pwllllplll llllllpgpa asqlrysvpe eqapgalvgn
  61 varalglelr rlgpgclrin hlgapspryl eldltsgalf vneridreal ceqrprclls
 121 levlahnpva vsaveveild indnsprfpr pnyqlqvses vapgarfhie saqdpdvgan
 181 svqtyelsps ehfeldlkpl qenskvlelv lrkgldreqa alhhlvltav dggiparsgt
 241 aqisvrvldt ndnspafdqs tyrvqlreds ppgtlvvkln asdpdegsng elrysissyt
 301 sdrerqlfsi dastgevrvi ggldyeeass yqiyvqatdr gpvpmaghck vlvdivdvnd
 361 napevvltdl yspvpenatp ntivavlsvn dqdsgpnrkv slgleatlpf rlngfgnsyt
 421 lvvsgpldre rvavynitvt atdggipqlt slrtlkveis dindnppsfl edsysiyiqe
 481 nnlpgvllct vqatdpdeke naevtyslle reiqglpvts yvsinsasgs lyavnsfdye
 541 kfreffvtve aqdkgsppls stvtanvyvv dmndhaphil yptstnssaa femvprtapa
 601 gylvtkviam dsdsgqnawl fyhlaqtsdl dlfkvelhtg eirttrkmgd esgstfnltv
 661 vvrdngepsl sasvaitvav vdrvskilpd tqrhvksprt yseitlylii alstvsfifl
```

TABLE 2-continued

```
 721 ltiiilsiik cyrytaygta ccggfcgvre rspaelykqa nnnidariph glkvqphfie
 781 vrgngsltkt ycykacltag sgsdtfmfyn tgaqtgpgps gaqaavtdsr nltgqsgqna
 841 gnliilknea vsqnevrqws ggllqthafv thppiscdla llsh
```

Gene ID:
X20

Gene symbol:
GPC4

Gene description:
Glypican 4

Unigene:
Hs.58367

Genbank:
AF030186

Entrez Gene:
2239

Refseq:
NM_001448

Protein sequence (SEQ ID NO (43)):
```
    1 mrllwklvil lplinssagd gllsrpiftq ephdvifpld lsksevilnc aangypsphy
   61 rwkqngtdid ftmsyhyrld ggslainsph tdqdigmyqc latnllgtil srkaklqfay
  121 iedfetktrs tvsvregqgv vllcgppphf gdlsyawtfn dnplyvqedn rrfvsqetgn
  181 lyiakvepsd vgnytcfitn keaqrsvqgp ptplvqrtdg vmgeyepkie vrfpetiqaa
  241 kdssvklecf algnpvpdis wrrldgsplp gkvkysksqa ileipnfqqe degfyecias
  301 nlrgrnlakg qlifyappew eqkiqnthls iydnllweck asgkpnpwyt wlkngerlnp
  361 eeriqiengt liitmlnvsd sgvyqcaaen kyqiiyanae lrvlasapdf skspvkkksf
  421 vqvggdivig ckpnafpraa iswkrgtetl rqskriflle dgslkiynit rsdagsytci
  481 atnqfgtakn tgslivkert vitvppskmd vtvgesivlp cqvshdpsie vvfvwffngd
  541 vidlkkgvah feriggesvg dlmirniqlh hsgkylctvq ttleslsava diivrgppgp
  601 pedvqvedis sttsqlswra gpdnnspiqi ftiqtrtpfs vgwqavatvp eilngktyna
  661 tvvglspwve yefrvvagns igigepseps ellrtkasvp vvapvnihgg ggrselvit
  721 wesipeelqn gegfgyiimf rpvgsttwsk ekvssvessr fvyrnesiip lspfevkvgv
  781 ynnegegsls tvtivysged epqlaprgts lqsfsaseme vswnaiawnr ntgrvlgyev
  841 lywtdddskes migkirvsgn vttknitglk antiyfasvr ayntagtgps sppvnvttkk
  901 sppsqppani awkltnsklc lnwehvktme nesevlgyki lyrqnrqskt hiletnntsa
  961 ellvpfeedy lieirtvsdg gdgssseeir ipkmsslssr giqflepsth flsivivifh
 1021 cfaiqpli
```

Gene ID:
X21

Gene symbol:
CNTN6

Gene description:
Contactin 6

Unigene:
Hs.387300

Genbank:
AB003592

Entrez Gene:
27255

Refseq:
NM_014461

Protein sequence (SEQ ID NO (44)):
```
    1 marfglpall ctlavlsaal laaelksksc sevrrlyvsk gfnkndaplh eingdhlkic
   61 pqgstccsqe meekyslqsk ddfksvvseq cnhlqavfas rykkfdeffk ellenaeksl
  121 ndmfvktygh lymqnselfk dlfvelkryy vvgnvnleem lndfwarlle rmfrlvnsqy
  181 hftdeylecv skyteqlkpf gdvprklklq vtrafvaart faqglavagd vvsksvvnp
  241 taqcthallk miycshcrgl vtvkpcynyc snimrgclan qgdldfewnn fidamlmvae
  301 rlegpfnies vmdpidvkis daimnmqdns vqvsqkvfqg cgppkplpag risrsisesa
  361 fsarfrphhp eerpttaagt sldrlvtdvk eklkqakkfw sslpsnvcnd ermaagngne
  421 ddcwngkgks rylfavtgng lanqgnnpev qvdtskpdil ilrqimalrv mtskmknayn
  481 gndvdffdis dessgegsgs gceyqqcpse fdynatdhag ksanekadsa gvrpgaqayl
  541 ltvfcilflv mqrewr
```

Gene ID:
X22

TABLE 2-continued

Gene symbol:
SLC9A7

Gene description:
solute carrier family 9 (sodium/hydrogen exchanger), member 7

Unigene:
Hs.496057

Genbank:
AF298591

Entrez Gene:
84679

Refseq:
NM_001257291|NM_032591

Protein sequence isoform 1 (SEQ ID NO (45)):
```
  1 mepgdaarpg sgratgappp rlllllplllg wglrvaaaas asssgaaaed ssameelate
 61 keaeeshrqd syslltfill ltltiltiwl fkhrrvrflh etglamiygl ivgvilrygt
121 patsgrdksl sctqedrafs tllvnvsgkf feytlkgeis pgkinsveqn dmlrkvtfdp
181 evffnillpp iifhagyslk krhffrnlgs ilayaflgta vscfiignlm ygvvklmkim
241 gqlsdkfyyt dclffgaiis atdpvtvlai fnelhadvdl yallfgesvl ndavaivlss
301 sivayqpagl nthafdaaaf fksvgiflgi fsgsftmgav tgvvtalvtk ftklhcfpll
361 etalfflmsw stfllaeacg ftgvvavlfc gitqahytyn nlsvesrsrt kqlfevlhfl
421 aenfifsymg lalftfqkhv fspifiigaf vaiflgraah iyplsfflnl grrhkigwnf
481 qhmmmfsglr gamafalair dtasyarqmm ftttlliyff tvwiigggtt pmlswlnirv
541 gveepseedq nehhwqyfry gvdpdqdppp nndsfqvlqg dgpdsargnr tkqesawifr
601 lwysfdhnyl kpilthsgpp ltttlpawcg llarcltspq vydnqeplre edsdfilteg
661 dltltygdst vtangsssh tastslegsr rtkssseevl erdlgmgdqk vssrgtrlvf
721 pledna
```

Protein sequence isoform 2 (SEQ ID NO (46)):
```
  1 mepgdaarpg sgratgappp rlllllplllg wglrvaaaas asssgaaaed ssameelate
 61 keaeeshrqd syslltfill ltltiltiwl fkhrrvrflh etglamiygl ivgvilrygt
121 patsgrdksl sctqedrafs tllvnvsgkf feytlkgeis pgkinsveqn dmlrkvtfdp
181 evffnillpp iifhagyslk krhffrnlgs ilayaflgta vscfiignlm ygvvklmkim
241 gqlsdkfyyt dclffgaiis atdpvtvlai fnelhadvdl yallfgesvl ndavaivlss
301 sivayqpagl nthafdaaaf fksvgiflgi fsgsftmgav tgvnanvtkf tklhcfplle
361 talfflmsws tfllaeacgf tgvvavlfcg itqahytynn lsvesrsrtq qlfevlhfla
421 enfifsymgl alftfqkhvf spifiigafv aiflgraahi yplsfflnlg rrhkigwnfq
481 hmmmfsglrg amafalaird tasyarqmmf tttllivfft vwiigggttp mlswlnirvg
541 veepseedqn ehhwqyfrvg vdpdqdpppn ndsfqvlqgd gpdsargnrt kqesawifrl
601 wysfdhnylk pilthsgppl ttrlpawcgl larcltspqv ydnqeplree dsdfiltegd
661 ltltygdstv tangsssht astslegsrr tksseevle rdlgmgdqkv ssrgtrlvfp
721 ledna
```

Gene ID:
X23

Gene symbol:
PVRL3

Gene description:
poliovirus receptor-related 3

Unigene:
Hs.293917

Genbank:
AK075105

Entrez Gene:
25945

Refseq:
NM_015480|NM_001243286|NM_001243288

Protein sequence isoform 1 (SEQ ID NO (47)):
```
  1 martlrpspl cpgggkaqls sasllgagll lqpptpppll lllfplllfs rlcgalagpi
 61 ivephvtavw gknvslkcli evnetitqis wekihgkssq tvavhhpqyg fsvqgeyqgr
121 vlfknyslnd atitlhnigf sdsgkyicka vtfplgnaqs sttvtvlvep tvslikgpds
181 lidggnetva aiciaatgkp vahidwegdl gemestttsf pnetatiisq yklfptrfla
241 grritcvvkh palekdirys fildiqyape svsvtgydgnw fvgrkgvnlk cnadanpppf
301 ksvwsrldgq wpdgllasdn tlhfvhpltf nysgvyickv tnslgqrsdq kviyisdppt
361 tttlqptiqw hpstadiedl atepkklpfp lstlatikdd tiatiiasvv ggalfivlvs
421 vlagifcyrr rrtfrgdyfa knyippsdmq kesqidvlqq deldsypdsv kkenknpvnn
481 lirkdyleep ektqwnnven lnrferpmdy yedlkmgmkf vsdehydene ddlvshvdgs
```

TABLE 2-continued

```
541 visrrewyv

Protein sequence isoform 2 (SEQ ID NO (48)):
   1 martlrpspl cpgggkaqls sasllgagll lqpptpppll lllfplllfs rlcgalagpi
  61 ivephvtavw gknvslkcli evnetitqis wekihgkssq tvavhhpqyg fsvqgeyqgr
 121 vlfknyslnd atitlhnigf sdsgkyicka vtfplgnaqs sttvtvlvep tvslikgpds
 181 lidggnetva aiciaatgkp vahidwegdl gemestttsf pnetatiisq yklfptrfar
 241 grritcvvkh palekdirys fildiqyape vsvtgydgnw fvgrkgvnlk cnadanpppf
 301 ksvwsrldgq wpdgllasdn tlhfvhpltf nysgvyickv tnslgqrsdq kviyisayns
 361 vaslnc Protein sequence isoform 3 (SEQ ID NO (49)):
   1 maegwrwcfv rrtpgllrgp llprsfsgnp ralagpiive phvtavwgkn vslkclievn
  61 etitqiswek ihgkssqtva vhhpqygfsv qgeyqgrvlf knyslndati tlhnigfsds
 121 gkyickavtf plgnaqsstt vtvlveptvs likgpdslid ggnetvaaic iaatgkpvah
 181 idwegdlgem estttsfpne tatiisqykl fptrfargrr itcvvkhpal ekdirysfil
 241 diqyapevsv tgydgnwfvg rkgvnlkcna danpppfksv wsrldgqwpd gllasdntlh
 301 fvhpltfnys gvyickvtns lgqrsdqkvi yisdvpfkqt ssiavagavi gavlalfiia
 361 ifvtvlltpr kkrpsyldkv idlppthkpp plyeersppl pqkdlfqpeh lplqtqfker
 421 evgnlqhsng lnsrsfdyed enpvgedgiq qmyplynqmc yqdrspgkhh qnndpkrvyi
 481 dprehyv Gene ID:
X24

Gene symbol:
SLC4A4

Gene description:
solute carrier family 4, sodium bicarbonate cotransporter,
member 4

Unigene:
Hs.5462

Genbank:
AF011390

Entrez Gene:
8671

Refseq:
NM_001098484|NM_001134742|NM_003759

Protein sequence isoform 1 (SEQ ID NO (50)):
   1 medeavldrg asflkhvcde eeveghhtiy igvhvpksyr rrrrhkrktg hkekkekeri
  61 senysdksdi enadessssi lkplispaae rirfilgeed dspappqlft eldellavdg
 121 qemewketar wikfeekveq ggerwskphv atlslhslfe lrtcmekgsi mldreasslp
 181 qlvemivdhq ietgllkpel kdkvtytllr khrhqtkksn lrsladigkt vssasrmftn
 241 pdngspamth rnltssslnd isdkpekdql knkfmkklpr daeasnvlvg evdfldtpfi
 301 afvrlqqavm lgaltevpvp trflfillgp kgkaksyhei graiatlmsd evfhdiayka
 361 kdrhdliagi defldevivl ppgewdpair ieppkslpss dkrknmysgg envqmngdtp
 421 hdgghggggh gdceelqrtg rfcgglikdi krkapffasd fydalniqal sailfiylat
 481 vtnaitfggl lgdatdnmqg vlesflgtav sgaifclfag qpltilsstg pvlvferllf
 541 nfskdnnfdy lefrlwiglw saflclilva tdasflvqyf trfteegfss lisfifiyda
 601 fkkmiklady ypinsnfkvg yntlfsctcv ppdpanisis ndttlapeyl ptmsstdmyh
 661 nttfdwafls kkecsyggn lvgnncnfvp ditlmsfilf lgtytssmal kkfktspyfp
 721 ttarklisdf aiilsilifc vidalvgvdt pklivpsefk ptspnrgwfv ppfgenpwwv
 781 claaaipall vtilifmdqq itavivnrke hklkkgagyh ldlfwvailm vicslmalpw
 841 yvaatvisia hidslkmete tsapgeqpkf lgvreqrvtg tlvfiltgls vfmapilkfi
 901 pmpvlygvfl ymgvaslngv qfmdrlklll mplkhqpdfi ylrhvplrrv hlftflqvlc
 961 lallwilkst vaaiifpvmi lalvavrkgm dylfsqhdls flddvipekd kkkkedekkk
1021 kkkkgsldsd nddsdcpyse kvpsikipmd imeqqpflsd skpsdrersp tflerhtsc Protein sequence isoform 3 (SEQ ID NO (51)):
   1 medeavldrg asflkhvcde eeveghhtiy igvhvpksyr rrrrhkrktg hkekkekeri
  61 senysdksdi enadessssi lkplispaae rirfilgeed dspappqlft eldellavdg
 121 qemewketar wikfeekveq ggerwskphv atlslhslfe lrtcmekgsi mldreasslp
 181 qlvemivdhq ietgllkpel kdkvtytllr khrhqtkksn lrsladigkt vssasrmftn
 241 pdngspamth rnltssslnd isdkpekdql knkfmkklpr daeasnvlvg evdfldtpfi
 301 afvrlqqavm lgaltevpvp trflfillgp kgkaksyhei graiatlmsd evfhdiayka
 361 kdrhdliagi defldevivl ppgewdpair ieppkslpss dkrknmysgg envqmngdtp
 421 hdgghggggh gdceelqrtg rfcgglikdi krkapffasd fydalniqal sailfiylat
 481 vtnaitfggl lgdatdnmqg vlesflgtav sgaifclfag qpltilsstg pvlvferllf
 541 nfskdnnfdy lefrlwiglw saflclilva tdasflvqyf trfteegfss lisfifiyda
 601 fkkmiklady ypinsnfkvg yntlfsctcv ppdpanisis ndttlapeyl ptmsstdmyh
 661 nttfdwafls kkecsyggn lvgnncnfvp ditlmsfilf lgtytssmal kkfktspyfp
 721 ttarklisdf aiilsilifc vidalvgvdt pklivpsefk ptspnrgwfv ppfgenpwwv
 781 claaaipall vtilifmdqq itavivnrke hklkkgagyh ldlfwvailm vicslmalpw
 841 yvaatvisia hidslkmete tsapgeqpkf lgvreqrvtg tivfiltgls vfmapilkfi
```

TABLE 2-continued

```
 901 pmpvlygvfl ymgvaslngv qfmdrlklll mplkhqpdfi ylrhyplrrv hlftflqvlc
 961 lallwilkst vaaiifpvmi lalvavrkgm dylfsqhdls flddvipekd kkkkedekkk
1021 kkkkgsldsd nddekdhqhs lnathhadki pflqslgmps pprtpvkvvp qirieleped
1081 ndyfwrskgt ettl Protein sequence isoform 2 (SEQ ID NO (52)):
   1 mstenvegkp snlgergrar sstflrvvqp mfnhsiftsa vspaaerirf ilgeeddspa
  61 ppqlftelde llavdgqeme wketarwikf eekveqgger wskphvatls lhslfelrtc
 121 mekgsimldr eassslpqlve mivdhqietg llkpelkdkv tytllrkhrh qtkksnlrsl
 181 adigktvssa srmftnpdng spamthrnlt ssslndisdk pekdqlknkf mkklprdaea
 241 snvlvgevdf ldtpfiafvr lqqavmlgal tevpvptrfl fillgpkgka ksyheigrai
 301 atlmsdevfh diaykakdrh dliagidefl devivlppge wdpairiepp kslpssdkrk
 361 nmysggenvq mngdtphdgg hgggghgdce elqrtgrfcg glikdikrka pffasdfyda
 421 lniqalsail fiylatvtna itfggllgda tdnmqgvles flgtaysgai fclfagqplt
 481 ilsstgpvlv ferlllnfsk dnnfdylefr lwiglwsafl clilvatdas flvqyftrft
 541 eegfsslisf ifiydafkkm ikladyypin snfkvgyntl fsctcvppdp anisisndtt
 601 lapeylptms stdmyhnttf dwaflskkec skyggnlvgn ncnfvpditl msfilflgty
 661 tssmalkkfk tspyfpttar klisdfaiil silifcvida lvgvdtpkli vpsefkptsp
 721 nrgwfvppfg enpwwvclaa aipallvtil ifmdqqitav ivnrkehklk kgagyhldlf
 781 wvailmvics lmalpwyvaa tvisiahids lkmetetsap geqpkflgvr eqrvtgtlvf
 841 iltglsvfma pilkfipmpv lygvflymgv aslngvqfmd rlklllmplk hqpdfiylrh
 901 vplrrvhlft flqvlclall wilkstvaai ifpvmilalv avrkgmdylf sqhdlsfldd
 961 vipekdkkkk edekkkkkkk gsldsdndds dcpysekvps ikipmdimeq qpflsdskps
1021 drersptfle rhtsc
```

Gene ID:
X25

Gene symbol:
CXADR

Gene description:
coxsackie virus and adenovirus receptor

Unigene:
Hs.634837

Genbank:
AY072912|AY072911|AY072910|AK313526|

Entrez Gene:
1525

Refseq:
NM_001338|NM_001207063|NM_001207064|NM_001207065|NM_001207066

```
Protein sequence isoform 1 (SEQ ID NO (53)):
   1 malllcfvll cgvvdfarsl sittpeemie kakgetaylp ckftlspedq gpldiewlis
  61 padnqkvdqv iilysgdkiy ddyypdlkgr vhftsndlks gdasinvtnl qlsdigtyqc
 121 kvkkapgvan kkihlvvlvk psgarcyvdg seeigsdfki kcepkegslp lqyewqklsd
 181 sqkmptswla emtssvisvk nasseysgty sctvrnrvgs dqcllrlnvv ppsnkaglia
 241 gaiigtllal aligliifcc rkkrreekye kevhhdired vpppksrtst arsyigsnhs
 301 slgsmspsnm egysktqynq vpsedfertp qsptlppakv aapnlsrmga ipvmipaqsk
 361 dgsiv Protein sequence isoform 2 (SEQ ID NO (54)):
   1 malllcfvll cgvvdfarsl sittpeemie kakgetaylp ckftlspedq gpldiewlis
  61 padnqkvdqv iilysgdkiy ddyypdlkgr vhftsndlks gdasinvtnl qlsdigtyqc
 121 kvkkapgvan kkihlvvlvk psgarcyvdg seeigsdfki kcepkegslp lqyewqklsd
 181 sqkmptswla gkmchlqrav rplpeatsav iihpwgpcll ptwkdiprls itkyqvktln
 241 allrvrlshl lr Protein sequence isoform 3 (SEQ ID NO (55)):
   1 malllcfvll cgvvdfarsl sittpeemie kakgetaylp ckftlspedq gpldiewlis
  61 padnqkvdqv iilysgdkiy ddyypdlkgr vhftsndlks gdasinvtnl qlsdigtyqc
 121 kvkkapgvan kkihlvvlgk mchlqravrp lpeatsavii hpwgpcllpt wkdiprlsit
 181 kyqvktlnal lrvrlshllr Protein sequence isoform 4 (SEQ ID NO (56)):
   1 malllcfvll cgvvdfarsl sittpeemie kakgetaylp ckftlspedq gpldiewlis
  61 padnqkvdqv grcatskepy vhcqklhrq Protein sequence isoform 5 (SEQ ID NO (57)):
   1 malllcfvll cgvvdfarsl sittpeemie kakgetaylp ckftlspedq gpldiewlis
  61 padnqkvdqv iilysgdkiy ddyypdlkgr vhftsndlks gdasinvtnl qlsdigtyqc
 121 kvkkapgvan kkihlvvlvk psgarcyvdg seeigsdfki kcepkegslp lqyewqklsd
 181 sqkmptswla emtssvisvk nasseysgty sctvrnrvgs dqcllrlnvv ppsnkaglia
 241 gaiigtllal aligliifcc rkkrreekye kevhhdired vpppksrtst arsyigsnhs
 301 slgsmspsnm egysktqynq vpsedfertp qsptlppakf kypyktdgit vv
```

TABLE 2-continued

Gene ID:
X26

Gene symbol:
CADM4

Gene description:
cell adhesion molecule 4

Unigene:
Hs.370984

Genbank:
AF363368

Entrez Gene:
199731

Refseq:
NM_145296

Protein sequence (SEQ ID NO (58)):
```
  1 mgrarrfqwp lllwaaaag pgagqevqte nvtvaeggva eitcrlhqyd gsivviqnpa
 61 rqtlffngtr alkderfqle efsprrvrir lsdarledeg gyfcqlyted thhqiatltv
121 lvapenpvve vreqavegge velsclvprs rpaatlrwyr drkelkgvss sqengkvwsv
181 astvrfrvdr kddggiiice aqnqalpsgh skqtqyvldv qysptariha sqavvregdt
241 lvltcavtgn prpnqirwnr gneslperae avgetltlpg lvsadngtyt ceasnkhgha
301 ralyvlvvyd pgavveaqts vpyaivggil allvfliicv lvgmvwcsvr qkgsylthea
361 sgldeqgear eaflngsdgh krkeeffi
```

Gene ID:
Y1

Gene symbol:
CLCA2

Gene description:
chloride channel accessory 2

Unigene:
Hs.241551

Genbank:
BC041096

Entrez Gene:
9635

Refseq:
NM_006536

Protein sequence (SEQ ID NO (59)):
```
  1 mtqrsiagpi cnlkfvtllv alsselpflg agvqlqdngy nglliainpq vpenqnlisn
 61 ikemiteasf ylfnatkrrv ffrnikilip atwkannnsk ikqesyekan vivtdwygah
121 gddpytlqyr gcgkegkyih ftpnfllndn ltagygsrgr vfvhewahlr wgvfdeynnd
181 kpfyinggnq ikvtrcssdi tgifvcekgp cpqenciisk lfkegctfiy nstqnatasi
241 mfmqslssvv efcnasthnq eapnlqnqmc slrsawdvit dsadfhhsfp mngtelpppp
301 tfslvqagdk vvclvldvss kmaeadrllq lqqaaefylm qiveihtfvg iasfdskgei
361 raqlhqinsn ddrkllvsyl pttvsaktdi sicsglkkgf evveklngka ygsvmilvts
421 gddkllgncl ptvlssgsti hsialgssaa pnleelsrlt gglkffvpdi snsnsmidaf
481 srissgtgdi fqqhiqlest genvkphhql kntvtvdntv gndtmflvtw qasgppeiil
541 fdpdgrkyyt nnfitnltfr taslwipgta kpghwtytln nthhslqalk vtvtsrasns
601 avppatveaf verdslhfph pvmiyanvkq gfypilnatv tatvepetgd pvtlrllddg
661 agadvikndg iysryffsfa angryslkvh vnhspsistp ahsipgsham yvpgytangn
721 iqmnaprksv grneeerkwg fsrvssggsf svlgvpagph pdvfppckii dleavkveee
781 ltlswtapge dfdqgqatsy eirmskslqn iqddfnnail vntskrnpqq agireiftfs
841 pqistngpeh qpngethesh riyvairamd rnslqsaysn iaqaplfipp nsdpvpardy
901 lilkgvltam gligiiclii vvthhtlsrk kradkkengt kll
```

Gene ID:
Y2

Gene symbol:
ECM1

Gene description:
extracellular matrix protein 1

Unigene:
Hs.81071

TABLE 2-continued

Genbank:
U68187|U68186|AK097046

Entrez Gene:
1893

Refseq:
NM_004425|NM_022664|NM_001202858

Protein sequence isoform 1 (SEQ ID NO (60)):
```
  1 mgttaraalv ltylavasaa seggftatgq rqlrpehfqe vgyaappspp lsrslpmdhp
 61 dssqhgppfe gqsvqppps qeatplqqek llpaqlpaek evgpplpqea vplqkelpsl
121 qhpneqkegt papfgdqshp epeswnaaqh cqqdrsqggw ghrldgfppg rpspdnlnqi
181 clpnrqhvvy gpwnlpqssy shltrqgetl nfleigysrc chcrshtnrl ecaklvweea
241 msrfceaefs vktrphwcct rqgearfscf qeeapqphyq lracpshqpd issglelpfp
301 pgvptldnik nichlrrfrs vprnlpatdp lqrellaliq lerefqrccr qgnnhtctwk
361 awedtldkyc dreyavkthh hlccrhppsp trdecfarra pypnydrdil tidigrvtpn
421 lmghlcgnqr vltkhkhipg lihnmtarcc dlpfpeqacc aeeekltfin dlcgprrniw
481 rdpalccyls pgdeqvncfn inylrnvalv sgdtenakgq geqgstggtn isstsepkee
```

Protein sequence isoform 2 (SEQ ID NO (61)):
```
  1 mgttaraalv ltylavasaa seggftatgq rqlrpehfqe vgyaappspp lsrslpmdhp
 61 dssqhgppfe gqsvqppps qeatplqqek llpaqlpaek evgpplpqea vplqkelpsl
121 qhpneqkegt papfgdqshp epeswnaaqh cqqdrsqggw ghrldgfppg rpspdnlnqi
181 clpnrqhvvy gpwnlpqssy shltrqgetl nfleigysrc chcrshtnrl ecaklvwedt
241 ldkycdreya vkthhhlccr hppsptrdec farrapypny drdiltidig rvtpnlmghl
301 cgnqrvltkh khipglihnm tarccdlpfp eqaccaeeek ltfindlcgp rrniwrdpal
361 ccylspgdeq vncfninylr nvalvsgdte nakgqgeqgs tggtnissts epkee
```

Protein sequence isoform 3 (SEQ ID NO (62)):
```
  1 mgttaraalv ltylavasaa seggftatgq rqlrpehfqe vgyaappspp lsrslpmdhp
 61 dssqhgppfe gqsgkegrgp rphsqpwlge rvgcshipps ivqpppsqea tplqqekllp
121 aqlpaekevg pplpqeavpl qkelpslqhp neqkegtpap fgdqshpepe swnaaqhcqq
181 drsqggwghr ldgfppgrps pdnlnqiclp nrqhvvygpw nlpqssyshl trqgetlnfl
241 eigysrcchc rshtnrleca klvweeamsr fceaefsvkt rphwcctrqg earfscfqee
301 apqphyqlra cpshqpdiss glelpfppgv ptldniknic hlrrfrsvpr nlpatdplqr
361 ellaliqler efqrccrqgn nhtctwkawe dtldkycdre yavkthhhlc crhppsptrd
421 ecfarrapyp nydrdiltid igrvtpnlmg hlcgnqrvlt khkhipglih nmtarccdlp
481 fpeqaccaee ekltfindlc gprrniwrdp alccylspgd eqvncfniny lrnvalvsgd
541 tenakgqgeq gstggtniss tsepkee
```

Gene ID:
Y3

Gene symbol:
CLDN1

Gene description:
claudin 1

Unigene:
Hs.439060

Genbank:
AY358652

Entrez Gene:
9076

Refseq:
NM_021101

Protein sequence (SEQ ID NO (63)):
```
  1 managlqllg filaflgwig aivstalpqw riysyagdni vtaqamyegl wmscvsqstg
 61 qiqckvfdsl lnlsstlqat ralmvvgill gviaifvatv gmkcmkcled devqkmrmav
121 iggaifllag lailvatawy gnrivqefyd pmtpvnarye fgqalftgwa aaslcllgga
181 llccscprkt tsyptprpyp kpapssgkdy v
```

Gene ID:
Y4

Gene symbol:
SFN

Gene description:
stratifin

Unigene:
Hs.523718

TABLE 2-continued

Genbank:
AF029082

Entrez Gene:
2810

Refseq:
NM_006142

Protein sequence (SEQ ID NO (64)):
```
  1 merasliqka klaeqaerye dmaafmkgav ekgeelscee rnllsvaykn vvggqraawr
 61 vlssieqksn eegseekgpe vreyrekvet elqgvcdtvl glldshlike agdaesrvfy
121 lkmkgdyyry laevatgddk kriidsarsa yqeamdiskk empptnpirl glalnfsvfh
181 yeianspeea islakttfde amadlhtlse dsykdstlim qllrdnltlw tadnageegg
241 eapqepqs
```

Gene ID:
Y5

Gene symbol:
CD9

Gene description:
CD9 antigen

Unigene:
Hs.114286

Genbank:
AY966455

Entrez Gene:
928

Refseq:
NM_001769

Protein sequence (SEQ ID NO (65)):
```
  1 mpvkggtkci kyllfgfnfi fwlagiavla iglwlrfdsq tksifeqetn nnnssfytgv
 61 yiligagalm mlvgflgccg avqesqcmlg lffgfllvif aieiaaaiwg yshkdevike
121 vqefykdtyn klktkdepqr etlkaihyal nccglaggve qfisdicpkk dvletftvks
181 cpdaikevfd nkfhiigavg igiavvmifg mifsmilcca irrnremv
```

Gene ID:
Y6

Gene symbol:
CD109

Gene description:
CD109 antigen

Unigene:
Hs.399891

Genbank:
AF410459

Entrez Gene:
135228

Refseq:
NM_133493|NM_001159587|NM_001159588

Protein sequence isoform 1 (SEQ ID NO (66)):
```
  1 mqgpplltaa hllcvctaal avapgprflv tapgiirpgg nvtigvelle hcpsqvtvka
 61 ellktasnlt svsvleaegvf ekgsfktltl pslplnsade iyelrvtgrt qdeilfsnst
121 rlsfetkris vfiqtdkaly kpkqevkfri vtlfsdfkpy ktslnilikd pksnliqqwl
181 sqqsdlgvis ktfqlsshpi lgdwsiqvqv ndqtyyqsfq vseyvlpkfe vtlqtplycs
241 mnskhlngti takytygkpv kgdvtltflp lsfwgkkkni tktfkingsa nfsfndeemk
301 nvmdssngls eyldlsspgp veilttvtes vtgisrnvst nvffkqhdyi ieffdyttvl
361 kpslnftatv kvtradgnql tleerrnnvv itvtqrnyte ywsgsnsgnq kmeavqkiny
421 tvpqsgtfki efpiledsse lqlkayflgs kssmavhslf kspsktyiql ktrdenikvg
481 spfelvvsgn krlkelsymv vsrgqlvavg kqnstmfslt penswtpkac vivyyieddg
541 eiisdvlkip vqlvfknkik lywskvkaep sekvslrisv tqpdsivgiv avdksvnlmn
601 asnditmenv vhelelyntg yylgmfmnsf avfqecglwv ltdanitkdy idgvydnaey
661 aerfmeeneg hivdihdfsl gssphvrkhf petwiwldtn mgyriyqefe vtvpdsitsw
721 vatgfvised lglgltttpv elqafqpffi flnlpysvir geefaleiti fnylkdatev
781 kviieksdkf dilmtsnein atghqqtllv psedgatvlf pirpthlgei pitvtalspt
```

TABLE 2-continued

```
 841 asdavtqmil vkaegieksy sqsilldltd nrlqstlktl sfsfppntvt gservqitai
 901 gdvlgpsing laslirmpyg cgeqnminfa pniyildylt kkkqltdnlk ekalsfmrqg
 961 yqrellyqre dgsfsafgny dpsgstwlsa fvlrcflead pyididqnvl hrtytwlkgh
1021 qksngefwdp grvihselqg gnkspvtlta yivtsllgyr kyqpnidvqe sihflesefs
1081 rgisdnytla lityalssvg spkakealnm ltwraeqegg mqfwvssesk lsdswqprsl
1141 dievaayall shflqfqtse gipimrwlsr qrnslggfas tqdttvalka lsefaalmnt
1201 ertniqvtvt gpsspspvkf lidthnrlll qtaelavvqp tavnisangf gfaicqlnvv
1261 ynvkasgssr rrrsiqnqea fdldvavken kddlnhvdln vctsfsgpgr sgmalmevnl
1321 lsgfmvpsea islsetvkkv eydhgklnly ldsvnetqfc vnipavrnfk vsntqdasvs
1381 ivdyyeprrq avrsynsevk lsscdlcsdv qgcrpcedga sgshhhssvi fifcfkllyf
1441 melwl Protein sequence isoform 2 (SEQ ID NO (67)):
   1 mqgpplltaa hllcvctaal avapgprflv tapgiirpgg nvtigvelle hcpsqvtvka
  61 ellktasnlt vsvleaegvf ekgsfktltl pslplnsade iyelrvtgrt qdeilfsnst
 121 rlsfetkris vfiqtdkaly kpkqevkfri vtlfsdfkpy ktslnilikd pksnliqqwl
 181 sqqsdlgvis ktfqlsshpi lgdwsiqvqv ndqtyyqsfq vseyvlpkfe vtlqtplycs
 241 mnskhlngti takytygkpv kgdvtltflp lsfwgkkkni tktfkingsa nfsfndeemk
 301 nvmdssngls eyldlsspgp veilttvtes vtgisrnvst nvffkqhdyi ieffdyttvl
 361 kpslnftatv kvtradgnql tleerrnnvv itvtqrnyte ywsgsnsgnq kmeavqkiny
 421 tvpqsgtfki efpiledsse lqlkayflgs kssmavhslf kspsktyiql ktrdenikvg
 481 spfelvvsgn krlkelsymv vsrgqlvavg kqnstmfslt penswtpkac vivyyieddg
 541 eiisdvlkip vqlvfknkik lywskvkaep sekvslrisv tqpdsivgiv avdksvnlmn
 601 asnditmenv vhelelyntg yylgmfmnsf avfqecglwv ltdanitkdy idgvydnaey
 661 aerfmeeneg hivdihdfsl gssphvrkhf petwiwldtn mgyriyqefe vtvpdsitsw
 721 vatgfvised lglglttpv elqafqpffi flnlpysvir geefaleiti fnylkdatev
 781 kviieksdkf dilmtsnein atghqqtllv psedgatvlf pirpthlgei pitvtalspt
 841 asdavtqmil vkaegieksy sqsilldltd nrlqstlktl sfsfppntvt gservqitai
 901 gdvlgpsing laslirmpyg cgeqnminfa pniyildylt kkkqltdnlk ekalsfmrqg
 961 yqrellyqre dgsfsafgny dpsgstwlsa fvlrcflead pyididqnvl hrtytwlkgh
1021 qksngefwdp grvihselqg gnkspvtlta yivtsllgyr kyqpnidvqe sihflesefs
1081 rgisdnytla lityalssvg spkakealnm ltwraeqegg mqfwvssesk lsdswqprsl
1141 dievaayall shflqfqtse gipimrwlsr qrnslggfas tqdttvalka lsefaalmnt
1201 ertniqvtvt gpsspsplav vqptavnisa ngfgfaicql nvvynvkasg ssrrrsiqn
1261 qeafdldvav kenkddlnhv dlnvctsfsg pgrsgmalme vnllsgfmvp seaislsetv
1321 kkveydhgkl nlyldsvnet qfcvnipavr nfkvsntqda sysivdyyep rrqavrsyns
1381 evklsscdlc sdvqgcrpce dgasgshhhs svififcfkl lyfmelwl Protein sequence isoform 3 (SEQ ID NO (68)):
   1 mqgpplltaa hllcvctaal avapgprflv tapgiirpgg nvtigvelle hcpsqvtvka
  61 ellktasnlt vsvleaegvf ekgsfktltl psdpksnliq qwlsqqsdlg visktfqlss
 121 hpilgdwsiq vqvndqtyyq sfqvseyvlp kfevtlqtpl ycsmnskhln gtitakytyg
 181 kpvkgdvtlt flplsfwgkk knitktfkin gsanfsfnde emknvmdssn glseyldlss
 241 pgpveilttv tesvtgisrn vstnvffkqh dyiieffdyt tvlkpslnft atvkvtradg
 301 nqltleerrn nvvitvtqrn yteywsgsns gnqkmeavqk inytvpqsgt fkiefpiled
 361 sselqlkayf lgskssmavh slfkspskty iqlktrdenikv kvgspfelvv sgnkrlkels
 421 ymvvsrgqlv avgkqnstmf sltpenswtp kacvivyyie ddgeiisdvl kipvqlvfkn
 481 kiklywskvk aepsekvslr isvtqpdsiv givavdksvn lmnasnditm envvhelely
 541 ntgyylgmfm nsfavfqecg lwvltdanlt kdyidgvydn aeyaerfmee neghivdihd
 601 fslgssphvr khfpetwiwl dtnmgyriyq efevtvpdsi tswvatgfvi sedlglgltt
 661 tpvelqafqp ffiflnlpys virgeefale itifnylkda tevkviieks dkfdilmtsn
 721 einatghqqt llvpsedgat vlfpirpthl geipitvtal sptasdavtq milvkaegie
 781 ksysqsilld ltdnrlqstl ktlsfsfppn tvtgservqi taigdvlgps inglaslirm
 841 pygcgeqnmi nfapniyild yltkkkqltd nlkekalsfm rqgyqrelly qredgsfsaf
 901 gnydpsgstw lsafvlrcfl eadpyididq nvlhrtytwl kghqksngef wdpgrvihse
 961 lqggnkspvt ltayivtsll gyrkyqpnid vqesihfles efsrgisdny tlalityals
1021 svgspkakea lnmltwraeq eggmqfwvss esklsdswqp rsldievaay allshflqfq
1081 tsegipimrw lsrqrnslgg fastqdttva lkalsefaal mntertniqv tvtgpsspsp
1141 vkflidthnr lllqtaelav vqptavnisa ngfgfaicql nvvynvkasg ssrrrsiqn
1201 qeafdldvav kenkddlnhv dlnvctsfsg pgrsgmalme vnllsgfmvp seaislsetv
1261 kkveydhgkl nlyldsvnet qfcvnipavr nfkvsntqda sysivdyyep rrqavrsyns
1321 evklsscdlc sdvqgcrpce dgasgshhhs svififcfkl lyfmelwl
```

Gene ID:
Y7

Gene symbol:
ITGB8

Gene description:
integrin, beta 8

Unigene:
Hs.592171

Genbank:
M73780

Entrez Gene:
3696

TABLE 2-continued

Refseq:
NM_002214

Protein sequence (SEQ ID NO (69)):
```
  1 mcgsalafft aafvclqndr rgpasflwaa wvfslvlglg qgednrcass naascarcla
 61 lgpecgwcvq edfisggsrs ercdivsnli skgcsvdsie ypsvhviipt eneintqvtp
121 gevsiqlrpg aeanfmlkvh plkkypvdly ylvdvsasmh nnieklnsvg ndlsrkmaff
181 srdfrlgfgs yvdktvspyi sihperihnq csdynldcmp phgyihvlsl tenitefeka
241 vhrqkisgni dtpeggfdam lqaavceshi gwrkeakrll lvmtdqtshl aldsklagiv
301 vpndgnchlk nnvyvksttm ehpslgqlse klidnninvi favqgkqfhw ykdllpllpg
361 tiageieska anlnnlvvea yqklisevkv qvenqvqgiy fnitaicpdg srkpgmegcr
421 nvtsndevlf nvtvtmkkcd vtggknyaii kpigfnetak ihihrncscq cednrgpkgk
481 cvdetfldsk cfqcdenkch fdedqfsses ckshkdqpvc sgrgvcvcgk cschkiklgk
541 vygkycekdd fscpyhhgnl caghgeceag rcqcfsgweg drcqcpsaaa qhcvnskgqv
601 csgrgtcvcg rcectdprsi grfcehcptc ytackenwnc mqclhphnls qaildqckts
661 calmeqqhyv dqtsecfssp sylriffiif ivtfligllk vliirqvilq wnsnkiksss
721 dyrvsaskkd klilqsvctr avtyrrekpe eikmdiskln ahetfrcnf
```

Gene ID:
Y8

Gene symbol:
EMP2

Gene description:
epithelial membrane protein 2

Unigene:
Hs.531561

Genbank:
BC009687

Entrez Gene:
2013

Refseq:
NM_001424

Protein sequence (SEQ ID NO (70)):
```
  1 mlvllafiia fhitsaallf iatvdnawwv gdeffadvwr ictnntnctv indsfqeyst
 61 lqavqatmil stilcciaff ifvlqlfrlk qgerfvltsi iqlmscicvm iaasiytdrr
121 edihdknakf ypvtregsyg ysyilawvaf actfisgmmy lilrkrk
```

Gene ID:
Y9

Gene symbol:
FGFBP1

Gene description:
fibroblast growth factor binding protein 1

Unigene:
Hs.1690

Genbank:
BC008910

Entrez Gene:
9982

Refseq:
NM_005130

Protein sequence (SEQ ID NO (71)):
```
  1 mkicsltlls flllaaqvll vegkkkvkng lhskvvseqk dtlgntqikq ksrpgnkgkf
 61 vtkdqancrw aateqeegis lkvectqldh efscvfagnp tsclklkder vywkqvarnl
121 rsqkdicrys ktavktrvcr kdfpessslkl vsstlfgntk prkektemsp rehikgkett
181 psslavtqtm atkapecved pdmanqrkta lefcgetwss lctfflsivq dtsc
```

Gene ID:
Y10

Gene symbol:
CDH3

Gene description:
cadherin 3, type 1, P-cadherin (placental)

TABLE 2-continued

Unigene:
Hs.191842

Genbank:
BC041846

Entrez Gene:
1001

Refseq:
NM_001793

Protein sequence (SEQ ID NO (72)):
```
   1 mglprgplas lllqvcwlq caaseperav freaevtlea ggaeqepgqa lgkvfmgcpg
  61 qepalfstdn ddftvrnget vqerrslker nplkifpskr ilrrhkrdwv vapisvpeng
 121 kgpfpqrinq lksnkdrdtk ifysitgpga dsppegvfav eketgwllln kpldreeiak
 181 yelfghayse ngasvedpmn isiivtdqnd hkpkftqdtf rgsvlegvlp gtsvmqvtat
 241 deddaiytyn gvvaysihsq epkdphdlmf tihrstgtis vissgldrek vpeytltiqa
 301 tdmdgdgstt tavavveild andnapmfdp qkyeahvpen avghevqrlt vtdldapnsp
 361 awratylimg gddgdhftit thpesnqgil ttrkgldfea knqhtlyvev tneapfvlkl
 421 ptstativvh vedvneapvf vppskvvevq egiptgepvc vytaedpdke nqkisyrilr
 481 dpagwlamdp dsgqvtavgt ldredeqfvr nniyevmvla mdngsppttg tgtllltlid
 541 vndhgpvpep rqiticnqsp vrqvinitdk dlsphtspfq aqltddsdiy wtaevneegd
 601 tvvlslkkfl kqdtydvhls lsdhgnkeql tviratvcdc hghvetcpgp wkggfilpvl
 661 gavlallfll lvllllvrkk rkikeplllp eddtrdnvfy ygeegggeed qdyditqlhr
 721 glearpevvl rndvaptiip tpmyrprpan pdeignfiie nlkaantdpt appydtllvf
 781 dyegsgsdaa slssltssas dqdqdydyln ewgsrfkkla dmygggedd
```

Gene ID:
Y11

Gene symbol:
ITGB4

Gene description:
integrin, beta 4

Unigene:
Hs.632226

Genbank:
X53587

Entrez Gene:
3691

Refseq:
NM_000213|NM_001005619|NM_001005731

Protein sequence isoform 1 (SEQ ID NO (73)):
```
   1 magprpspwa rllaalisv slsgtlanrc kkapvkscte cvrvdkdcay ctdemfrdrr
  61 cntqaellaa gcqresivvm essfqiteet qidttlrrsq mspqglrvrl rpgeerhfel
 121 evfeplespv dlyilmdfsn smsddldnlk kmgqnlarvl sqltsdytig fgkfvdkvsv
 181 pqtdmrpekl kepwpnsdpp fsfknvislt edvdefrnkl qgerisgnld apeggfdail
 241 qtavctrdig wrpdsthllv fstesafhye adganvlagi msrnderchl dttgtytqyr
 301 tqdypsvptl vrllakhnii pifavtnysy syyeklhtyf pvsslgvlqe dssnivelle
 361 eafnrirsnl diraldsprg lrtevtskmf qktrtgsfhi rrgevgiyqv qlralehvdg
 421 thvcqlpedq kgnihlkpsf sdglkmdagi icdvctcelq kevrsarcsf ngdfvcgqcv
 481 csegwsgqtc ncstgslsdi qpclregedk pcsgrgecqc ghcvcygegr yegqfceydn
 541 fqcprtsgfl cndrgrcsmg qcvcepgwtg pscdcplsna tcidsnggic ngrghcecgr
 601 chchqqslyt dticeinysa ihpglcedlr scvqcqawgt gekkgrtcee cnfkvkmvde
 661 lkraeevvvr csfrdedddc tysytmegdg apgpnstvlv hkkkdcppgs fwwlipllll
 721 llpllallll lcwkycacck aclallpccn rghmvgfked hymlrenlma sdhldtpmlr
 781 sgnlkgrdvv rwkvtnnmqr pgfathaasi nptelvpygl slrlarlcte nllkpdtrec
 841 aqlrqeveen lnevyrqisg vhklqqtkfr qqpnagkkqd htivdtvlma prsakpallk
 901 ltekqveqra fhdlkvapgy ytltadqdar gmvefqegve lvdvrvplfi rpedddekql
 961 lveaidvpag tatlgrrlvn itiikeqard vvsfeqpefs vsrgdqvari pvirrvldgg
1021 ksqvsyrtqd gtaqgnrdyi pvegellfqp geawkelqvk llelqevdsl lrgrqvrrfh
1081 vqlsnpkfga hlgqphstti iirdpdeldr sftsqmlssq ppphgdlgap qnpnakaags
1141 rkihfnwlpp sgkpmgyrvk ywiqgdsese ahlldskvps veltnlypyc dyemkvcayg
1201 aqgegpyssl vscrthqevp sepgrlafnv vsstvtqlsw aepaetngei tayevcyglv
1261 nddnrpigpm kkvlvdnpkn rmllienlre sqpyrytvka rngagwgper eaiinlatqp
1321 krpmsipiip dipivdaqsg edydsflmys ddvlrspsgs qrpsysddtg cgwkfepllg
1381 eeldlrrvtw rlppeliprl sassgrssda eaphgppddg gaggkggslp rsatpgppge
1441 hlvngrmdfa fpgstnslhr mtttsaaayg thlsphvphr vlststltr dynsltrseh
1501 shsttlprdy stltsysshd srltagvpdt ptrlvfsalg ptslrvswqe prcerplqgy
1561 sveyqllngg elhrinipnp aqtsvvvedl lpnhsyvfrv raqsqegwgr eregvities
1621 qvhpqslcp lpgsaftlst psapgplvft alspdslqls werprrpngd ivgylvtcem
1681 aqgggpataf rvdgdspesr ltvpglsenv pykfkvqart tegfgpereg iitiesqdgg
```

TABLE 2-continued

```
1741 pfpqlgsrag lfqhplqsey ssittthtsa tepflvdglt lgaqhleagg sltrhvtqef
1801 vsrtlttsgt lsthmdqqff qt Protein sequence isoform 2 (SEQ ID NO (74)):
   1 magprpspwa rlllaalisv slsgtlanrc kkapvkscte cvrvdkdcay ctdemfrdrr
  61 cntqaellaa gcqresivvm essfqiteet qidttlrrsq mspqglrvrl rpgeerhfel
 121 evfeplespv dlyilmdfsn smsddldnlk kmgqnlarvl sqltsdytig fgkfvdkvsv
 181 pqtdmrpekl kepwpnsdpp fsfknvislt edvdefrnkl qgerisgnld apeggfdail
 241 qtavctrdig wrpdsthllv fstesafhye adganvlagi msrnderchl dttgtytqyr
 301 tqdypsvptl vrllakhnii pifavtnysy syyeklhtyf pvsslgvlqe dssnivelle
 361 eafnrirsnl diraldsprg lrtevtskmf qktrtgsfhi rrgevgiyqv qlralehvdg
 421 thvcqlpedq kgnihlkpsf sdglkmdagi icdvctcelq kevrsarcsf ngdfvcgqcv
 481 csegwsgqtc ncstgslsdi qpclregedk pcsgrgecqc ghcvcygegr yegqfceydn
 541 fqcprtsgfl cndrgrcsmg qcvcepgwtg pscdcplsna tcidsnggic ngrghcecgr
 601 chchqqslyt dticeinysa ihpglcedlr scvqcqawgt gekkgrtcee cnfkvkmvde
 661 lkraeevvvr csfrdedddc tysytmegdg apgpnstvlv hkkkdcppgs fwwlipllll
 721 llpllallll lcwkycacck aclallpccn rghmvgfked hymlrenlma sdhldtpmlr
 781 sgnlkgrdvv rwkvtnnmqr pgfathaasi nptelvpygl slrlarlcte nllkpdtrec
 841 aqlrqeveen lnevyrqisg vhklqqtkfr qqpnagkkqd htivdtvlma prsakpallk
 901 ltekqveqra fhdlkvapgy ytltadqdar gmvefqegve lvdvrvplfi rpedddekql
 961 lveaidvpag tatlgrrlvn itiikeqard vvsfeqpefs vsrgdqvari pvirrvldgg
1021 ksqvsyrtqd gtaqgnrdyi pvegellfqp geawkelqvk llelqevdsl lrgrqvrrfh
1081 vqlsnpkfga hlgqphstti iirdpdeldr sftsqmlssq ppphgdlgap qnpakaags
1141 rkihfnwlpp sgkpmgyrvk ywiqgdsese ahlldskvps veltnlypyc dyemkvcayg
1201 aqgegpyssl vscrthqevp sepgrlafnv vsstvtqslw aepaetngei tayevcyglv
1261 nddnrpigpm kkvlvdnpkn rmllienlre sqpyrytvka rngagwgper eaiinlatqp
1321 krpmsipiip dipivdaqsg edydsflmys ddvlrspsgs qrpsysddte hlvngrmdfa
1381 fpgstnslhr mtttsaaayg thlsphvphr vlstsstltr dynsltrseh shsttlprdy
1441 stltsvsshg lppiwehgrs rlplswalgs rsraqmkgfp psrgprdsii lagrpaapsw
1501 gpdsrltagv pdtptrlvfs algptslrvs wqeprcerpl qgysveyqll nggelhrini
1561 pnpaqtsvvv edllpnhsyv frvraqsqeg wgreregvit iesqvhpqsp lcplpgsaft
1621 lstpsapgpl vftalspdsl qlswerprrp ngdivgylvt cemaqgggpa tafrvdgdsp
1681 esrltvpgls envpykfkvq arttegfgpe regiitiesq dggpfpqlgs raglfqhplq
1741 seyssittth tsatepflvd gltlgaqhle aggsltrhvt qefvsrtltt sgtlsthmdq
1801 qffqt Protein sequence isoform 3 (SEQ ID NO (75)):
   1 magprpspwa rlllaalisv slsgtlanrc kkapvkscte cvrvdkdcay ctdemfrdrr
  61 cntqaellaa gcqresivvm essfqiteet qidttlrrsq mspqglrvrl rpgeerhfel
 121 evfeplespv dlyilmdfsn smsddldnlk kmgqnlarvl sqltsdytig fgkfvdkvsv
 181 pqtdmrpekl kepwpnsdpp fsfknvislt edvdefrnkl qgerisgnld apeggfdail
 241 qtavctrdig wrpdsthllv fstesafhye adganvlagi msrnderchl dttgtytqyr
 301 tqdypsvptl vrllakhnii pifavtnysy syyeklhtyf pvsslgvlqe dssnivelle
 361 eafnrirsnl diraldsprg lrtevtskmf qktrtgsfhi rrgevgiyqv qlralehvdg
 421 thvcqlpedq kgnihlkpsf sdglkmdagi icdvctcelq kevrsarcsf ngdfvcgqcv
 481 csegwsgqtc ncstgslsdi qpclregedk pcsgrgecqc ghcvcygegr yegqfceydn
 541 fqcprtsgfl cndrgrcsmg qcvcepgwtg pscdcplsna tcidsnggic ngrghcecgr
 601 chchqqslyt dticeinysa ihpglcedlr scvqcqawgt gekkgrtcee cnfkvkmvde
 661 lkraeevvvr csfrdedddc tysytmegdg apgpnstvlv hkkkdcppgs fwwlipllll
 721 llpllallll lcwkycacck aclallpccn rghmvgfked hymlrenlma sdhldtpmlr
 781 sgnlkgrdvv rwkvtnnmqr pgfathaasi nptelvpygl slrlarlcte nllkpdtrec
 841 aqlrqeveen lnevyrqisg vhklqqtkfr qqpnagkkqd htivdtvlma prsakpallk
 901 ltekqveqra fhdlkvapgy ytltadqdar gmvefqegve lvdvrvplfi rpedddekql
 961 lveaidvpag tatlgrrlvn itiikeqard vvsfeqpefs vsrgdqvari pvirrvldgg
1021 ksqvsyrtqd gtaqgnrdyi pvegellfqp geawkelqvk llelqevdsl lrgrqvrrfh
1081 vqlsnpkfga hlgqphstti iirdpdeldr sftsqmlssq ppphgdlgap qnpakaags
1141 rkihfnwlpp sgkpmgyrvk ywiqgdsese ahlldskvps veltnlypyc dyemkvcayg
1201 aqgegpyssl vscrthqevp sepgrlafnv vsstvtqslw aepaetngei tayevcyglv
1261 nddnrpigpm kkvlvdnpkn rmllienlre sqpyrytvka rngagwgper eaiinlatqp
1321 krpmsipiip dipivdaqsg edydsflmys ddvlrspsgs qrpsysddte hlvngrmdfa
1381 fpgstnslhr mtttsaaayg thlsphvphr vlstsstltr dynsltrseh shsttlprdy
1441 stltsysshd srltagvpdt ptrlvfsalg ptslrvswqe prcerplqgy sveyqllngg
1501 elhrinipnp aqtsvvvedl lpnhsyvfrv raqsqegwgr eregvities aqgggpataf
1561 lpgsaftlst psapgplvft alspdslqls werprrpngd ivgylvtcem aqgggpataf
1621 rvdgdspesr ltvpglsenv pykfkvqart tegfgpereg iitiesqdgg pfpqlgsrag
1681 lfqhplqsey ssittthtsa tepflvdglt lgaqhleagg sltrhvtqef vsrtlttsgt
1741 lsthmdqqff qt
```

Gene ID:
Y12

Gene symbol:
LAMB3

Gene description:
laminin, beta 3

Unigene:
Hs.497636

TABLE 2-continued

Genbank:
BC075838

Entrez Gene:
3914

Refseq:
NM_000228

Protein sequence (SEQ ID NO (76)):
```
   1 mrpffllcfa lpgllhaqqa csrgacyppv gdllvgrtrf lrasstcglt kpetyctqyg
  61 ewqmkcckcd srqphnyysh rvenvasssg pmrwwqsqnd vnpvslqldl drrfqlqevm
 121 mefqgpmpag mlierssdfg ktwrvyqyla adctstfprv rqgrpqswqd vrcqslpqrp
 181 narlnggkvq lnlmdlvsgi patqsqkiqe vgeitnlrvn ftrlapvpqr gyhppsayya
 241 vsqlrlqgsc fchghadrca pkpgasagps tavqvhdvcv cqhntagpnc ercapfynnr
 301 pwrpaegqda hecqrcdcng hsetchfdpa vfaasqgayg gvcdncrdht egkncercql
 361 hyfrnrrpga siqetcisce cdpdgavpga pcdpvtgqcv ckehvqgerc dlckpgftgl
 421 tyanpqgchr cdcnilgsrr dmpcdeesgr clclpnvvgp kcdqcapyhw klasgqgcep
 481 cacdphnsls pqcnqftgqc peregfgglm csaaairqcp drtygdvatg cracdcdfrg
 541 tegpgcdkas grclcrpglt gprcdcqrg ycnrypvcva chpcfqtyda dlreqalrfg
 601 rlrnataslw sgpgledrgl asrildaksk ieqiravlss pavteqevaq vasailslrr
 661 tlqglqldlp leeetlslpr dlesldrsfn glltmyqrkr eqfekissad psgafrmlst
 721 ayeqsaqaaq qvsdssrlld qlrdsrreae rlvrqagggg gtgspklval rlemsslpdl
 781 tptfnklcgn srqmactpis cpgelcpqdn gtacgsrcrg vlpraggafl magqvaeqlr
 841 gfnaqlqrtr qmiraaeesa sqiqssaqrl etqvsasrsq meedvrrtrl liqqvrdflt
 901 dpdtdaatiq evseavlalw lptdsatvlq kmneiqaiaa rlpnvdlvls qtkqdiarar
 961 rlqaeaeear srahavegqv edvvgnlrqg tvalqeaqdt mqqtsrsrl iqdrvaevqq
1021 vlrpaeklvt smtkqlgdfw trmeelrhqa rqqgaeavqa qqllaegaseq alsaqegfer
1081 ikqkyaelkd rlgqssmlge qgariqsvkt eaeelfgetm emmdrmkdme lellrgsgai
1141 mlrsadltgl ekrveqirdh ingrvlyyat ck
```

Gene ID:
Y13

Gene symbol:
CD55

Gene description:
CD55 antigen

Unigene:
Hs.126517

Genbank:
M31516

Entrez Gene:
1604

Refseq:
NM_000574

Protein sequence (SEQ ID NO (77)):
```
   1 mtvarpsvpa alpllgelpr llllvllclp avwgdcglpp dvpnaqpale grtsfpedtv
  61 itykceesfv kipgekdsvi clkgsqwsdi eefcnrscev ptrlnsaslk qpyitqnyfp
 121 vgtvveyecr pgyrrepsls pkltclqnlk wstavefckk kscpnpgeir ngqidvpggi
 181 lfgatisfsc ntgyklfgst ssfclisgss vqwsdplpec reiycpappq idngiiqger
 241 dhygyrqsvt yacnkgftmi gehsiyctvn ndegewsgpp pecrgkslts kvpptvqkpt
 301 tvnvpttevs ptsqktttkt ttpnaqatrs tpvsrttkhf hettpnksg ttsgttrlls
 361 ghtcfltltgl lgtivtmgll t
```

Gene ID:
Y14

Gene symbol:
CLDN16

Gene description:
claudin 16

Unigene:
Hs.251391

Genbank:
BC069682

Entrez Gene:
10686

TABLE 2-continued

Refseq:
NM_006580

Protein sequence (SEQ ID NO (78)):
```
   1 mtsrtpllvt aclyysycns rhlqqgvrks krpvfshcqv petqktdtrh lsgaragvcp
  61 cchpdgllat mrdllqyiac ffaffsagfl ivatwtdcwm vnaddslevs tkcrglwwec
 121 vtnafdgirt cdeydsilae hplklvvtra lmitadilag fgfltlllgl dcvkflpdep
 181 yikvricfva gatlliagtp giigsvwyav dvyverstlv lhniflgiqy kfgwscwlgm
 241 agslgcflag avltcclylf kdvgpernyp yslrkaysaa gvsmaksysa prtetakmya
 301 vdtrv
```

Gene ID:
Y15

Gene symbol:
LAMA3

Gene description:
laminin, alpha 3

Unigene:
Hs.436367

Genbank:
AY327115

Entrez Gene:
3909

Refseq:
NM_198129|NM_001127717|NM_000227|NM_001127718

Protein sequence isoform 1 (SEQ ID NO (79)):
```
   1 maaaarprgr algpvlpptp llllvlrvlp acgatardpg aaaglslhpt yfnlaeaari
  61 watatcgerg pgegrpqpel ycklvggpta pgsghtiqgq fcdycnsedp rkahpvtnai
 121 dgserwwqsp plssgtqynr vnltldlgql fhvayilikf ansprpdlwv lersvdfgst
 181 yspwqyfahs kvdclkefgr eanmavtrdd dvlcvteysr ivplengevv vslingrpga
 241 knftfshtlr eftkatnirl rflrtntllg hliskaqrdp tvtrryyysi kdisiggqcv
 301 cnghaevcni nnpeklfrce cqhhtcgetc drcctgynqr rwrpaaweqs heceacnchg
 361 hasncyydpd verqqaslnt qgiyagggvc incqhntagv nceqcakgyy rpygvpvdap
 421 dgcipcscdp ehadgceqgs grchckpnfh gdncekcaig yynfpfclri pifpvstpss
 481 edpvagdikg cdcnlegvlp eicdahgrcl crpgvegqprc dtcrsgfysf picqacwcsa
 541 lgsyqmpcss vtgqcecrpg vtgqrcdrcl sgaydfphcq gsssacdpag tinsnlgycq
 601 cklhvegptc srckllywnl dkenpsgcse ckchkagtvs gtgecrqgdg dchckshvgg
 661 dscdtcedgy faleksnyfg cqgcqcdigg alssmcsgps gvcqcrehvv gkvcqrpenn
 721 yyfpdlhhmk yeiedgstpn grdlrfgfdp lafpefswrg yaqmtsvqnd vritlnvgks
 781 sgslfrvilr yvnpgteays ghitiypswg aaqskeiifl pskepafvtv pgngfadpfs
 841 itpgiwvaci kaegvlldyl vllprdyyea svlqlpvtep cayagppqen cllyqhlpvt
 901 rfpctlacea rhflldgepr pvavrqptpa hpvmvdlsgr evelhlrlri pqvghyvvvv
 961 eysteaaqlf vvdvnvkssg svlagqvniy scnysvlcrs avidhmsria myelladadi
1021 qlkghmarfl lhqvciipie efsaeyvrpq vhciasygrf vnqsatcvsl ahetpptali
1081 ldvlsgrpfp hlpqqsspsv dvlpgvtlka pqnqvtlrgr vphlgryvfv ihfyqaahpt
1141 fpaqvsvdgg wpragsfhas fcphvlgcrd qviaegqief disepevaat vkvpegkslv
1201 lvrvlvvpae nydyqilhkk smdkslefit ncgknsfyld pqtasrfckn sarslvafyh
1261 kgalpcechp tgatgphcsp eggqcpcqpn vigrqctrca tghygfprck pcscgrrlce
1321 emtgqcrcpp rtvrpqcevc ethsfsfhpm agcegcncsr rgtieaampe cdrdsgqcrc
1381 kpritgrqcd rcasgfyrfp ecvpcncnrd gtepgvcdpg tgaclckenv egtecnvcre
1441 gsfhldpanl kgctscfcfg vnnqchsshk rrtkfvdmlg whletadrvd ipvsfnpgsn
1501 smvadlqelp atihsaswva ptsylgdkvs syggyltyqa ksfglpgdmv llekkpdvql
1561 tgqhmsiiye etntprpdrl hhgrvhvveg nfrhassrap vsreelmtvl srladvriqg
1621 lyftetqrlt lsevgleeas dtgsgriala veicacppay agdscqgcsp gyyrdhkgly
1681 tgrcvpcncn ghsnqcqdgs gicvncqhnt agehcercqe gyygnavhgs cracpcphtn
1741 sfatgcvvng gdvrcsckag ytgtqcerca pgyfgnpqkf ggscqpcscn snqglgschp
1801 ltgdcinqep kdsspaeecd dcdscvmtll ndlatmgeql rlyksqlqgl sasaglleqm
1861 rhmetqakdl rnqllnyrsa isnhgskieg lereltdlnq efetlqekaq vnsrkaqtln
1921 nnvnratqsa keldvkiknv irnhillkq isgtdgegnn vpsgdfsrew aeaqrmmrel
1981 rnrnfgkhlr eaeadkresq llllnrirtwq kthqgenngl ansirdslne yeaklsdlra
2041 rlqeaaaqak qanglngene ralgaiqrqv keinslqsdf tkylttadss llqtnialql
2101 meksqkeyek laaslnearq elsdkvrels rsagktslve eaekharslq elakqleeik
2161 rnasgdelvr cavdaataye nilnaikaae daanraasas esalqtvike dlprkaktls
2221 snsdkllnea kmtqkklqge vspalnnlqq tlnivtvqke vidtnltttlr dglhgiqrgd
2281 idamissaks mvrkanditd evldglnpiq tdverikdty grtqnedfkk altdadnsvn
2341 kltnklpdlw rkiesinqql lplgnisdnm drireliqqa rdaaskvavp mrfngksgve
2401 vrlpndledl kgytslslfl qrpnsrengg tenmfvmylg nkdasrdyig mavvdgqltc
2461 vynlgdreae lqvdqiltks etkeavmdry kfqriyqfar lnytkgatss kpetpgvydm
2521 dgrnsntlln ldpenvvfyv ggyppdfklp srlsfppykg cieldlnen vlslynfkkt
2581 fnlnttevep crrrkeesdk nyfegtgyar vptqphapip tfgqtiqttv drgllffaen
2641 gdrfislnie dgklmvrykl nselpkergv gdainngrdh siqikigklq krmwinvdvq
2701 ntiidgevfd fstyylggip iairerfnis tpafrgcmkn lkktsgvvrl ndtvgvtkkc
```

TABLE 2-continued

```
2761 sedwklvrsa sfsrggqlsf tdlglpptdh lqasfgfqtf qpsgilldhq twtrnlqvtl
2821 edgyielsts dsgspifksp qtymdgllhy vsvisdnsgl rlliddqllr nskrlkhiss
2881 srqslrlggs nfegcisnvf vqrlslspev ldltsnslkr dvslggcsln kppflmllkg
2941 strfnkttkf rinqllqdtp vasprsvkvw qdacsplpkt qanhgalqfg diptshllfk
3001 lpqellkprs qfavdmqtts srglvfhtgt knsfmalyls kgrlvfalgt dgkklriksk
3061 ekcndgkwht vvfghdgekg rlvvdglrar egslpgnsti sirapvylgs ppsgkpkslp
3121 tnsfvgclkn fqldskplyt psssfgvssc lggplekgiy fseegghvvl ahsvllgpef
3181 klvfsirprs ltgilihigs qpgkhlcvyl eagkvtasmd sgaggtstsv tpkqslcdgq
3241 whsvavtikq hilhleldtd ssytagqipf ppastqeplh lggapanltt lripvwksff
3301 gclrnihvnh ipvpvteale vqgpvslngc pdq Protein sequence isoform 3 (SEQ ID NO (80)):
   1 maaaarprgr algpvlpptp llllvlrvlp acgatardpg aaaglslhpt yfnlaeaari
  61 watatcgerg pgegrpqpel ycklvggpta pgsghtiqgq fcdycnsedp rkahpvtnai
 121 dgserwwqsp plssgtqynr vnltldlgql fhvayilikf ansprpdlwv lersvdfgst
 181 yspwqyfahs kvdclkefgr eanmavtrdd dvlcvteysr ivplengevv vslingrpga
 241 knftfshtlr eftkatnirl rflrtntllg hliskaqrdp tvtrryyysi kdisigggcv
 301 cnghaevcni nnpeklfrce cqhhtcgetc drcctgynqr rwrpaaweqs heceacnchg
 361 hasncyydpd verqqaslnt qgiyagggvc incqhntagv nceqcakgyy rpygvpvdap
 421 dgcipcscdp ehadgceqgs grchckpnfh gdncekcaig yynfpfclri pifpvstpss
 481 edpvagdikg cdcnlegvlp eicdahgrcl crpgvegprc dtcrsgfysf picqacwcsa
 541 lgsyqmpcss vtgqcecrpg vtgqrcdrcl sgaydfphcq gsssacdpag tinsnlgycq
 601 cklhvegptc srckllywnl dkenpsgcse ckchkagtvs gtgecrqqdg dchckshvgg
 661 dscdtcedgy faleksnyfg cqgcqcdigg alssmcsgps gvcqcrehvv gkvcqrpenn
 721 yyfpdlhhmk yeiedgstpn grdlrfgfdp lafpefswrg yaqmtsvqnd vritlnvgks
 781 sgslfrvilr yvnpgteavs ghitiypswg aaqskeiifl pskepafvtv pngfadpfs
 841 itpgiwvaci kaegvlldyl vllprdyyea svlqlpvtep cayagppqen cllyqhlpvt
 901 rfpctlacea rhflldgepr pvavrqptpa hpvmvdlsgr evelhlrlri pqvghyvvvv
 961 eysteaaqlf vvdvnvkssg svlagqvniy scnysvlcrs avidhmsria myelladadi
1021 qlkghmarfl lhqvciipie efsaeyvrpq vhciasygrf vnqsatcvsl ahetpptali
1081 ldvlsgrpfp hlpqqsspsv dvlpgvtlka pqnqvtlrgr vphlgryvfv ihfyqaahpt
1141 fpaqvsvdgg wpragsfhas fcphvlgcrd qviaegqief disepevaat vkvpegkslv
1201 lvrvlvvpae nydyqilhkk smdkslefit ncgknsfyld pqtasrfckn sarslvafyh
1261 kgalpceechp tgatgphcsp eggqcpcqpn vigrqctrca tghygfprck pcscgrrlce
1321 emtgqcrcpp rtvrpqcevc ethsfsfhpm agcegcncsr rgtieaampe cdrdsgqcrc
1381 kpritgrqcd rcasgfyrfp ecvpncnrd gtepgvcdpg tgaclckenv egtecnvcre
1441 gsfhldpanl kgctscfcfg vnnqchsshk rrtkfvdmlg whletadrvd ipvsfnpgsn
1501 smvadlqelp atihsaswva ptsylgdkvs syggyltyqa ksfglpgdmv llekkpdvql
1561 tgqhmsiiye etntprpdrl hhgrvhvveg nfrhassrap vsreelmtvl srladvriqg
1621 lyftetqrlt lsevgleeas dtgssgriala veicacppay agdscqgcsp gyyrdhkgly
1681 tgrcvpcncn ghsnqcqdgs gicvncqhnt agehcercqe gyygnavhgs cracpcphtn
1741 sfatgcvvng gdvrcsckag ytgtqcerca pgyfgnpqkf ggscqpcscn snqglgschp
1801 ltgdcinqep kdsspaeecd dcdscvmtll ndlatmgeql rlyksqlqgl sasagleqm
1861 rhmetqakdl rnqllnyrsa isnhgskieg lereltdlnq efetlqekaq vnsrkaqtln
1921 nnvnratqsa keldvkiknv irnvhmlnri rtwqkthqge nnglansird slneyeakls
1981 dlrarlqeaa aqakqangln qeneralgai qrqvkeinsl qsdftkyltt adssllqtni
2041 alqlmeksqk eyeklaasln eargelsdkv relsrsagkt slveeaekha rslqelakql
2101 eeikrnasgd elvrcavdaa tayenilnai kaaedaanra asasesalqt vikedlprka
2161 ktlssnsdkl lneakmtqkk lkqevspaln nlqqtlnivt vqkevidtnl ttlrdglhgi
2221 qrgdidamis saksmvrkan ditdevldgl npiqtdveri kdtygrtqne dfkkaltdad
2281 nsvnkltnkl pdlwrkiesi nqqllplgni sdnmdrirel iqqardaask vavpmrfngk
2341 sgvevrlpnd ledlkgytsl slflqrpnsr enggtenmfv mylgnkdasr dyigmavvdg
2401 qltcvynlgd reaelqvdqi ltksetkeav mdrvkfqriy qfarlnytkg atsskpetpg
2461 vydmdgrnsn tllnldpenv vfyvggyppd fklpsrlsfp pykgcieldd lnenvlslyn
2521 fkktfnlntt eveperrrke esdknyfegt gyarvptqph apiptfgqti qttvdrgllf
2581 faengdrfis lniedgklmv ryklnselpk ergvgdainn grdhsiqiki gklqkrmwin
2641 vdvqntiidg evfdfstyyl ggipiairer fnistpafrg cmknlkktsg vvrlndtvgv
2701 tkkcsedwkl vrsasfsrgg qlsftdlglp ptdhlqasfg fqtfqpsgil ldhqtwtrnl
2761 qvtledgyie lstsdsgspi fkspqtymdg llhyvsvisd nsglrllidd qllrnskrlk
2821 hisssrqslr lggsnfegci snvfvqrlsl spevldltsn slkrdvslgg cslnkppflm
2881 llkgstrfnk tktfrinqll qdtpvasprs vkvwqdacsp lpktqanhga lqfgdiptsh
2941 llfklpqell kprsqfavdm qttssrglvf htgtknsfma lylskgrlvf algtdgkklr
3001 ikskekcndg kwhtvvfghd gekgrlvvdg lraregslpg nstisirapv ylgsppsgkp
3061 kslptnsfvg clknfqldsk plytpsssfg vssclggple kgiyfseegg hvvlahsvll
3121 gpefklvfsi rprsltgili higsqpgkhl cvyleagkvt asmdsgaggt stsvtpkqsl
3181 cdgqwhsvav tikqhilhle ldtdssytag qipfppastq eplhlggapa nlttlripvw
3241 ksffgclrni hvnhipvpvt ealevqgpvs lngcpdq Protein sequence isoform 2 (SEQ ID NO (81)):
   1 mppavrrsac smgwlwifga algqclgyss qqqrvpflqp pggqsqlqasy vefrpsqgcs
  61 pgyyrdhkgl ytgrcvpcnc nghsnqcqdg sgicvncqhn tagehcercq egyygnavhg
 121 scracpcpht nsfatgcvvn ggdvrcscka gytgtqcerc apgyfgnpqk fggscqpcsc
 181 nsngqlgsch pltgdcinqe pkdsspaeec ddcdscvmtl lndlatmgeq lrlyksqlqg
 241 lsasaglleq mrhmetqakd lrnqllnyrs aisnhgskie glereltdln qefetlqeka
 301 qvnsrkaqtl nnnvnratqs akeldvkikn virnvhmlnri qisgtdgegn nvpsgdfsre
 361 waeaqrmmre lrnrnfgkhl reaeadkres qlllnrirtw qkthqgenng lansirdsln
 421 eyeaklsdlr arlqeaaaqa kqanglnqen eralgaiqrq vkeinslqsd ftkylttads
 481 sllqtnialq lmeksqkeye klaaslnear qelsdkvrel srsagktslv eeaekharsl
 541 qelakqleei krnasgdeiv rcavdaatay enilnaikaa edaanraasa sesalqtvik
 601 edlprkaktl ssnsdkllne akmtqkklkq evspalnnlq qtlnivtvqk evidtnlttl
```

TABLE 2-continued

```
 661 rdglhgiqrg didamissak smvrkandit devldglnpi qtdverikdt ygrtqnedfk
 721 kaltdadnsv nkltnklpdl wrkiesinqq llplgnisdn mdrireliqq ardaaskvav
 781 pmrfngksgv evrlpndled lkgytslslf lqrpnsreng gtenmfvmyl gnkdasrdyi
 841 gmavvdgqlt cvynlgdrea elqvdqiltk setkeavmdr vkfqriyqfa rlnytkgats
 901 skpetpgvyd mdgrnsntll nldpenvvfy vggyppdfkl psrlsfppyk gcielddlne
 961 nvlslynfkk tfnlntteve pcrrrkeesd knyfegtgya rvptqphapi ptfgqtiqtt
1021 vdrgllffae ngdrfislni edgklmvryk lnselpkerg vgdainngrd hsiqikigkl
1081 qkrmwinvdv qntiidgevf dfstyylggi piairerfni stpafrgcmk nlkktsgvvr
1141 lndtvgvtkk csedwklvrs asfsrggqls ftdlglpptd hlqasfgfqt fqpsgilldh
1201 qtwtrnlqvt ledgyielst sdsgspifks pqtymdgllh yvsvisdnsg lrllidddqll
1261 rnskrlkhis ssrqslrlgg snfegcisnv fvqrlslspe vldltsnslk rdvslggcsl
1321 nkppflmllk gstrfnktkt frinqllqdt pvasprsvkv wqdacsplpk tqanhgalqf
1381 gdiptshllf klpqellkpr sqfavdmqtt ssrglvfhtg tknsfmalyl skgrlvfalg
1441 tdgkklriks kekcndgkwh tvvfghdgek grlvvdglra regslpgnst isirapvylg
1501 sppsgkpksl ptnsfvgclk nfqldskply tpsssfgvss clggplekgi yfseegghvv
1561 lahsvllgpe fklvfsirpr sltgilihig sqpkhlcvy leagkvtasm dsgaggtsts
1621 vtpkqslcdg qwhsvavtik qhilhleldt dssytagqip fppastqepl hlggapanlt
1681 tlripvwksf fgclrnihvn hipvpvteal evqgpvslng cpdq Protein sequence isoform 4 (SEQ ID NO (82)):
   1 mppavrrsac smgwlwifga algqclgyss qqqrvpflqp pggsqlqasy vefrpsqgcs
  61 pgyyrdhkgl ytgrcvpcnc nghsnqcqdg sgicvncqhn tagehcercq egyygnavhg
 121 scracpcpht nsfatgcvvn ggdvrcscka gytgtqcerc apgyfgnpqk fggscqpcsc
 181 nsngqlgsch pltgdcinqe pkdsspaeec ddcdscvmtl lndlatmgeq lrlyksqlqg
 241 lsasaglleq mrhmetqakd lrnqllnyrs aisnhgskie glereltdln qefetlqeka
 301 qvnsrkaqtl nnnvnratqs akeldvkikn virnvhmlnr irtwqkthqg ennglansir
 361 dslneyeakl sdlrarlqea aaqakqangl nqeneralga iqrqvkeins lqsdftkylt
 421 tadssllqtn ialqlmeksq keyeklaasl nearqelsdk vrelsrsagk tslveeaekh
 481 arslqelakq leeikrnasg delvrcavda atayenilna ikaaedaanr aasasesalq
 541 tvikedlprk aktlssnsdk llneakmtqk klkqevspal nnlqqtlniv tvqkevidtn
 601 lttlrdglhg iqrgdidami ssaksmvrka nditdevldg lnpiqtdver ikdtygrtqn
 661 edfkkaltda dnsvnkltnk lpdlwrkies inqqllplgn isdnmdrire liqqardaas
 721 kvavpmrfng ksgvevrlpn dledlkgyts lslflqrpns renggtenmf vmylgnkdas
 781 rdyigmavvd gqltcvynlg dreaelqvdq iltksetkea vmdrvkfqri yqfarlnytk
 841 gatsskpetp gvydmdgrns ntllnldpen vvfyvggypp dfklpsrlsf ppykgcield
 901 dlnenvlsly nfkktfnlnt tevepcrrrk eesdknyfeg tgyarvptqp hapiptfgqt
 961 iqttvdrgll ffaengdrfi slniedgklm vryklnselp kergvgdain ngrdhsiqik
1021 igklqkrmwi nvdvqntiid gevfdfstyy lggipiaire rfnistpafr gcmknlkkts
1081 gvvrlndtvg vtkkcsedwk lvrsasfsrg gqlsftdlgl pptdhlqasf gfqtfqpsgi
1141 lldhqtwtrn lqvtledgyi elstsdsgsp ifkspqtymd gllhyvsvis dnsglrllid
1201 dqllrnskrl khisssrqsl rlggsnfegc isnvfvqrls lspevldlts nslkrdvslg
1261 gcslnkppfl mllkgstrfn ktktfringl lqdtpvaspr svkvwqdacs plpktqanhg
1321 alqfgdipts hllfklpqel lkprsqfavd mqttssrglv fhtgtknsfm alylskgrlv
1381 falgtdgkkl rikskekcnd gkwhtvvfgh dgekgrlvvd glraregslp gnstisirap
1441 vylgsppsgk pkslptnsfv gclknfqlds kplytpsssf gvssclggpl ekgiyfseeg
1501 ghvvlahsvl lgpefklvfs irprsltgil ihigsqpkh lcvyleagkv tasmdsgagg
1561 tstsvtpkqs lcdgqwhsva vtikqhilhl eldtdssyta gqipfppast qeplhlggap
1621 anlttlripv wksffgclrn ihvnhipvpv tealevqgpv slngcpdq
```

Gene ID:
Y16

Gene symbol:
CD40

Gene description:
CD40 molecule

Unigene:
Hs.472860

Genbank:
AB209660

Entrez Gene:
958

Refseq:
NM_001250|NM_152854

Protein sequence isoform 1 (SEQ ID NO (83)):
```
   1 mvrlplqcvl wgclltavhp epptacrekq ylinsqccsl cqpgqklvsd cteftetecl
  61 pcgeseflt wnrethchqh kycdpnlglr vqqkgtsetd tictceegwh ctseacescv
 121 lhrscspgfg vkqiatgvsd ticepcpvgf fsnvssafek chpwtscetk dlvvqqagtn
 181 ktdvvcgpqd rlralvvipi ifgilfaill vlvfikkvak kptnkaphpk qepqeinfpd
 241 dlpgsntaap vqetlhgcqp vtqedgkesr isvqerq
```

Protein sequence isoform 2 (SEQ ID NO (84)):
```
   1 mvrlplqcvl wgclltavhp epptacrekq ylinsqccsl cqpgqklvsd cteftetecl
  61 pcgeseflt wnrethchqh kycdpnlglr vqqkgtsetd tictceegwh ctseacescv
```

TABLE 2-continued

```
121 lhrscspgfg vkqiatgvsd ticepcpvgf fsnvssafek chpwtrspgs aespggdphh
181 lrdpvchplg aglyqkggqe anq
```

Gene ID:
Y17

Gene symbol:
COL17A1

Gene description:
collagen, type XVII, alpha 1

Unigene:
Hs.117938

Genbank:
AL138761

Entrez Gene:
1308

Refseq:
NM_000494

Protein sequence (SEQ ID NO (85)):
```
   1 mdvtkknkrd gtevterivt etvttrltsl ppkggtsngy aktaslgggs rlekqslthg
  61 ssgyinstgs trghastssy rrahspastl pnspgstfer kthvtrhaye gsssgnsspe
 121 yprkefasss trgrsqtres eirvrlqsas pstrwteldd vkrllkgsrs asvsptrnss
 181 ntlpipkkgt vetkivtass qsysgtydat ildanlpshv wsstlpagss mgtyhnnmtt
 241 qsssllntna ysagsvfgvp nnmascsptl hpglstsssv fgmqnnlaps lttlshgttt
 301 tstaygvkkn mpqspaavnt gvstsaactt svqgsddllhk dckflilekd ntpakkemel
 361 limtkdsgkv ftaspasiaa tsfsedtlkk ekqaaynads glkaeangdl ktvstkgktt
 421 tadihsygss ggggsggggg vggagggpwg papawcpcgs ccswwkwllg llltwllllg
 481 llfglialae evrklkarvd elerirrsil pygdsmdrie kdrlqgmapa agadldkigl
 541 hsdsqeelwm fvrkklmmeq engnlrgspg pkgdmspgp kgdrgfpgtp gipgplghpg
 601 pqgpkgqkgs vgdpgmegpm gqrgregpmg prgeagppgs gekgergaag epgphgppgv
 661 pgsvgpkgss gspgpqgppg pvglqglrge vglpgvkgdk gpmgpgpgkg dqgekgprgl
 721 tgepgmrglp gavgepgakg amgpagpdgh qgprgeqglt gmpgirgppg psgdpgkpgl
 781 tgpqgpqglp gtpgrpgikg epgapgkivt segssmltvp gppgppgamg ppgppgapgp
 841 agpaglpghq evlnlqgppg ppgprgppgp sipgppgprg ppgeglpgpp gppgsflsns
 901 etflsgppgp pgpgpkgdq gppgprghqg eqglpgfsts gsssfglnlq gppgppgpqg
 961 pkgdkgdpgv pgalgipsgp seggsssmtmy vsgppgppgp ppgsisss gqeiqqyise
1021 ymqsdsirsy lsgvqgppgp pgppgpvtti tgetfdysel ashvvsylrt sgygvslfss
1081 sissedilav lqrddvrqyl rqylmgprgp pgppgasgdg sllsldyael ssrilsymss
1141 sgisiglpgp pgpgplpgts yeellsllrg sefrgivgpp gppgppgipg nvwssisved
1201 lssylhtagl sfipgppgpp gppgprgppg vsgalatyaa ensdsfrsel isyltspdvr
1261 sfivgppgpp gpqgppgdsr llstdashsr gssssshsss vrrgssysss mstgggags
1321 lgaggafgea agdrgpygtd igpgggygaa aeggmyagng gllgadfagd ldynelavrv
1381 sesmqrqgll qgmaytvqgp pgqpgpqgpp giskvfsays nvtadlmdff qtygaiqgpp
1441 gqkgemgtpg pkgdrgpagp pghpgppgpr ghkgekgdkg dqvyagrrrr rsiavkp
```

Gene ID:
Y18

Gene symbol:
DSC2

Gene description:
Desmocollin-2

Unigene:
Hs.95612

Genbank:
BC063291

Entrez Gene:
1824

Refseq:
NM_024422|NM_004949

Protein sequence isoform Dsc2a (SEQ ID NO (86)):
```
   1 meaarpsgsw ngalcrllll tlailifasd acknvtlhvp skldaeklvg rvnlkecfta
  61 anlihssdpd fqiledgsvy ttntillsse krsftillsn tenqekkif vflehqtkvl
 121 kkrhtkekvl rrakrrwapi pcsmlenslg pfplflqqvq sdtaqnytiy ysirgpgvdq
 181 eprnlfyver dtgnlyctrp vdreqyesfe iiafattpdg ytpelplpli ikiedendny
 241 pifteetytf tifencrvgt tvgqvcatdk depdtmhtrl kysiigqvpp sptlfsmhpt
 301 tgvitttssq ldrelidkyq lkikvqdmdg qyfglqttst ciniddvnd hlptftrtsy
 361 vtsveentvd veilrvtved kdlvntanwr anytilkgne ngnfkivtda ktnegvlcvv
```

TABLE 2-continued

```
421 kplnyeekqq milqigvvne apfsreaspr samstatvtv nvedqdegpe cnppiqtvrm
481 kenaevgtts ngykaydpet rsssgirykk ltdptgwvti dentgsikvf rsldreaeti
541 kngiynitvl asdqggrtct gtlgiilqdv ndnspfipkk tviickptms saeivavdpd
601 epihgppfdf slesstsevq rmwrlkaind taarlsyqnd ppfgsyvvpi tvrdrlgmss
661 vtsldvticd citendcthr vdprigggv qlgkwailai llgiallfci lftivcgasg
721 tskqpkvipd dlaqqnlivs nteapgddkv ysangfttqt vgasaqgvcg tvgssikngg
781 qetiemvkgg hqtsescrga ghhhtldscr gghtevdncr ytysewhsft qprlgekvyl
841 cnqdenhkha qdyvltynye grgsvagsvg ccserqeedg lefldnlepk frtlaeacmk
901 r
```

Protein sequence isoform Dsc2b (SEQ ID NO (87)):
```
  1 meaarpsgsw ngalcrllll tlailifasd acknvtlhvp skldaeklvg rvnlkecfta
 61 anlihssdpd fqiledgsvy tttntillsse krsftillsn tenqekkkif vflehqtkvl
121 kkrhtkekvl rrakrrwapi pcsmlenslg pfplflqqvq sdtaqnytiy ysirgpgvdq
181 eprnlfyver dtgnlyctrp vdreqyesfe iiafattpdg ytpelplpli ikiedendny
241 piftetytf tifencrvgt tvgqvcatdk depdtmhtrl kysiigqvpp sptlfsmhpt
301 tgvittssq ldrelidkyq lkikvqdmdg qyfglqttst ciiniddvnd hlptftrtsy
361 vtsveentvd veilrvtved kdlvntanwr anytilkgne ngnfkivtda ktnegvlcvv
421 kpinyeekqq milqigvvne apfsreaspr samstatvtv nvedqdegpe cnppiqtvrm
481 kenaevgtts ngykaydpet rsssgirykk ltdptgwvti dentgsikvf rsldreaeti
541 kngiynitvl asdqggrtct gtlgiilqdv ndnspfipkk tviickptms saeivavdpd
601 epihgppfdf slesstsevq rmwrlkaind taarlsyqnd ppfgsyvvpi tvrdrlgmss
661 vtsldvtlcd citendcthr vdprigggv qlgkwailai llgiallfci lftivcgasg
721 tskqpkvipd dlaqqnlivs nteapgddkv ysangfttqt vgasaqgvcg tvgssikngg
781 qetiemvkgg hqtsescrga ghhhtldscr gghtevdncr ytysewhsft qprlgeesir
841 ghtlikn
```

Gene ID:
Y19

Gene symbol:
DSC1

Gene description:
Desmocollin-1

Unigene:
Hs.567260

Genbank:
X72925

Entrez Gene:
1823

Refseq:
NM_024421|NM_004948

Protein sequence isoform Dsc1a (SEQ ID NO (88)):
```
  1 malasaapgs ifckqllfsl lvltllcdac qkvylrvpsh lqaetivgkv nleeclksas
 61 lirssdpafr iledgsiytt hdlilssersk sfsiflsdgq rreqqeikvv lsarenkspk
121 krhtkdtalk rskrrwapip aslmenslgp fpqhvqqiqs daaqnytify sisgpgvdke
181 pfnlfyiekd tgdifctrsi drekyeqfal ygyattadgy apeyplplii kieddndnap
241 yfehrvtift vpencrsgts vgkvtatdld epdtlhtrlk ykilqqipdh pkhfsihpdt
301 gvittttpfl drekcdtyql imevrdmggq pfglfntgti tisledednd ppsftetsyv
361 teveenridv eilrmkvqdq dlpntphska vykilqgnen gnfiistdpn tnegvlcvvk
421 plnyevnrqv ilqvgvinea qfskaasqt ptmctttvtv kiidsdegpe chppvkviqs
481 qdgfpaggel lgykaldpei ssgeglryqk lgdednwfei nqhtgdlrtl kvldreskfv
541 knnqynisvv avdavgrsct gtlvvhlddy ndhapqidke vticqnnedf avlkpvdpdg
601 pengppfqff ldnsasknwn ieekdgktai lrqrqnldyn yysvpiqikd rhglvathml
661 tvrvcdcstp secrmkdkst rdvrpnvilg rwailamvlg svlllcilft cfcvtakrtv
721 kkcfpediaq qnlivsnteg pgeevteani rlpmqtsnic dtsmsvgtvg gqgiktqqsf
781 emvkggytld snkgghqtl esvkgvgqgd tgryaytdwq sftqprlgek vylcgqdeeh
841 khcedyvcsy nyegkgslag svgccsdrqe eeglefldhl epkfrtlakt cikk
```

Protein sequence isoform Dsc1b (SEQ ID NO (89)):
```
  1 malasaapgs ifckqllfsl lvltllcdac qkvylrvpsh lqaetlvgkv nleeclksas
 61 lirssdpafr iledgsiytt hdlilssersk sfsiflsdgq rreqqeikvv lsarenkspk
121 krhtkdtalk rskrrwapip aslmenslgp fpqhvqqiqs daaqnytify sisgpgvdke
181 pfnlfyiekd tgdifctrsi drekyeqfal ygyattadgy apeyplplii kieddndnap
241 yfehrvtift vpencrsgts vgkvtatdld epdtlhtrlk ykilqqipdh pkhfsihpdt
301 gvittttpfl drekcdtyql imevrdmggq pfglfntgti tisledednd ppsftetsyv
361 teveenridv eilrmkvqdq dlpntphska vykilqgnen gnfiistdpn tnegvlcvvk
421 plnyevnrqv ilqvgvinea qfskaasqt ptmctttvtv kiidsdegpe chppvkviqs
481 qdgfpaggel lgykaldpei ssgeglryqk lgdednwfei nqhtgdlrtl kvldreskfv
541 knnqynisvv avdavgrsct gtlvvhlddy ndhapqidke vticqnnedf avlkpvdpdg
601 pengppfqff ldnsasknwn ieekdgktai lrqrqnldyn yysvpiqikd rhglvathml
661 tvrvcdcstp secrmkdkst rdvrpnvilg rwailamvlg svlllcilft cfcvtakrtv
721 kkcfpediaq qnlivsnteg pgeevteani rlpmqtsnic dtsmsvgtvg gqgiktqqsf
781 emvkggytld snkgghqtl esvkgvgqgd tgryaytdwq sftqprlgee sirghtlikn
```

TABLE 2-continued

Gene ID:
Y20

Gene symbol:
ITGA6

Gene description:
Integrin alpha-6

Unigene:
Hs.133397

Genbank:
X59512

Entrez Gene:
3655

Refseq:
NM_000210|NM_001079818

Protein sequence isoform b (SEQ ID NO (90)):
```
   1 maaagqlcll ylsagllsrl gaafnldtre dnvirkygdp gslfgfslam hwqlqpedkr
  61 lllvgaprae alplqranrt gglyscdita rgpctriefd ndadptsesk edqwmgvtvq
 121 sqgpggkvvt cahryekrqh vntkqesrdi fgrcyvlsqn lrieddmdgg dwsfcdgrlr
 181 ghekfgscqq gvaatftkdf hyivfgapgt ynwkgivrve qknntffdmn ifedgpyevg
 241 getehdeslv pvpansylgf sldsgkgivs kdeitfvsga pranhsgavv llkrdmksah
 301 llpehifdge glassfgydv avvdlnkdgw qdivigapqy fdrdgevgga vyvymnqqgr
 361 wnnvkpirin gtkdsmfgia vknigdinqd gypdiavgap yddlgkvfiy hgsangintk
 421 ptqvlkgisp yfgysiagnm dldrnsypdv avgslsdsvt ifrsrpvini qktitvtpnr
 481 idlrqktacg apsgiclqvk scfeytanpa gynpsisivg tleaekerrk sglssrvqfr
 541 nqgsepkytq eltlkrqkqk vcmeetlwlq dnirdklrpi pitasveiqe pssrrrynsl
 601 pevlpilnsd epktahidvh flkegcgddn vcnsnlkley kfctregnqd kfsylpiqkg
 661 vpelvlkdqk dialeitvtn spsnprnptk dgdddaheakl iatfpdtlty sayrelrafp
 721 ekqlscvanq ngsqadcelg npfkrnsnvt fylvlsttev tfdtpdldin lklettsnqd
 781 nlapitakak vvielllsvs gvakpsqvyf ggtvvgeqam ksedevgsli eyefrvinlg
 841 kpltnlgtat lniqwpkeis ngkwllylvk veskglekvt cepqkeinsl niteshnsrk
 901 kreitekqid dnrkfslfae rkyqtlncsv nvncvnircp lrgldskasl ilrsrlwnst
 961 fleeysklny ldilmrafid vtaaaenirl pnagtqvrvt vfpsktvaqy sgvpwwiilv
1021 ailagilmla llvfilwkcg ffkrnkkdhy datyhkaeih aqpsdkerlt sda
```

Protein sequence isoform a (SEQ ID NO (91)):
```
   1 maaagqlcll ylsagllsrl gaafnldtre dnvirkygdp gslfgfslam hwqlqpedkr
  61 lllvgaprae alplqranrt gglyscdita rgpctriefd ndadptsesk edqwmgvtvq
 121 sqgpggkvvt cahryekrqh vntkqesrdi fgrcyvlsqn lrieddmdgg dwsfcdgrlr
 181 ghekfgscqq gvaatftkdf hyivfgapgt ynwkgivrve qknntffdmn ifedgpyevg
 241 getehdeslv pvpansylgf sldsgkgivs kdeitfvsga pranhsgavv llkrdmksah
 301 llpehifdge glassfgydv avvdlnkdgw qdivigapqy fdrdgevgga vyvymnqqgr
 361 wnnvkpirin gtkdsmfgia vknigdinqd gypdiavgap yddlgkvfiy hgsangintk
 421 ptqvlkgisp yfgysiagnm dldrnsypdv avgslsdsvt ifrsrpvini qktitvtpnr
 481 idlrqktacg apsgiclqvk scfeytanpa gynpsisivg tleaekerrk sglssrvqfr
 541 nqgsepkytq eltlkrqkqk vcmeetlwlq dnirdklrpi pitasveiqe pssrrrynsl
 601 pevlpilnsd epktahidvh flkegcgddn vcnsnlkley kfctregnqd kfsylpiqkg
 661 vpelvlkdqk dialeitvtn spsnprnptk dgdddaheakl iatfpdtlty sayrelrafp
 721 ekqlscvanq ngsqadcelg npfkrnsnvt fylvlsttev tfdtpdldin lklettsnqd
 781 nlapitakak vvielllsvs gvakpsqvyf ggtvvgeqam ksedevgsli eyefrvinlg
 841 kpltnlgtat lniqwpkeis ngkwllylvk veskglekvt cepqkeinsl nlteshnsrk
 901 kreitekqid dnrkfslfae rkyqtlncsv nvncvnircp lrgldskasl ilrsrlwnst
 961 fleeysklny ldilmrafid vtaaaenirl pnagtqvrvt vfpsktvaqy sgvpwwiilv
1021 ailagilmla llvfilwkcg ffkrsrydds vpryhavrir keereikdek yidnlekkqw
1081 itkwnenesy s
```

Gene ID:
Y21

Gene symbol:
ITGB4

Gene description:
Integrin beta-4

Unigene:
Hs.632226

Genbank:
X53587|X51841|X52186

Entrez Gene:
3691

TABLE 2-continued

Refseq:
NM_000213|NM_001005619|NM_001005731

Protein sequence isoform 1 (SEQ ID NO (92)):

```
   1 magprpspwa rlllaalisv slsgtlanrc kkapvkscte cvrvdkdcay ctdemfrdrr
  61 cntqaellaa gcqresivvm essfqiteet qidttlrrsq mspqglrvrl rpgeerhfel
 121 evfeplespv dlyilmdfsn smsddldnlk kmgqnlarvl sqltsdytig fgkfvdkvsv
 181 pqtdmrpekl kepwpnsdpp fsfknvislt edvdefrnkl qgerisgnld apeggfdail
 241 qtavctrdig wrpdsthllv fstesafhye adganvlagi msrnderchl dttgtytqyr
 301 tqdypsvptl vrllakhnii pifavtnysy syyeklhtyf pvsslgvlqe dssnivelle
 361 eafnrrirsnl diraldsprg lrtevtskmf qktrtgsfhi rrgevgiyqv qlralehvdg
 421 thvcqlpedq kgnihlkpsf sdglkmdagi icdvctcelq kevrsarcsf ngdfvcgqcv
 481 csegwsgqtc ncstgslsdi qpclregedk pcsgrgecqc ghcvcygegr yegqfceeydn
 541 fqcprtsgfl cndrgrcsmg qcvcepgwtg pscdcplsna tcidsnggic ngrghceecgr
 601 chchqqslyt dticeinysa ihpglcedlr scvqcqawgt gekkgrtcee cnfkvkmvde
 661 lkraeeevvvr csfrdedddc tysytmegdg apgpnstvlv hkkkdcppgs fwwliplll
 721 llpllalll lcwkycacck aclallpccn rghmvgfked hymlrenlma sdhldtpmlr
 781 sgnlkgrdvv rwkvtnnmqr pgfathaasi nptelvpygl slrlarlcte nllkpdtrec
 841 aqlrqeveen lnevyrqisg vhklqqtkfr qqpnagkkqd htivdtvlma prsakpallk
 901 ltekqveqra fhdlkvapgy ytltadqdar gmvefqegve lvdvrvplfi rpedddekql
 961 lveaidvpag tatlgrrlvn itiikeqard vvsfeqpefs vsrgdqvari pvirrvldgg
1021 ksqvsyrtqd gtaqgnrdyi pvegellfqp geawkelqvk llelqevdsl lrgrqvrrfh
1081 vqlsnpkfga hlgqphstti iirdpdeldr sftsqmlssq ppphgdlgap qnpnakaags
1141 rkihfnwlpp sgkpmgyrvk ywiqgdsese ahlldskvps veltnlypyc dyemkvcayg
1201 aqgegpyssl vscrthqevp sepgrlafnv vsstvtqlsw aepaetngei tayevcyglv
1261 nddnrpigpm kkvlvdnpkn rmllienlre sqpyrytvka rngagwgper eaiinlatqp
1321 krpmsipiip dipivdaqsg edydsflmys ddvlrspsgs qrpsysddtg cgwkfepllg
1381 eeedlrrvtw rlppeliprl sassgrssda eaphgppddg gaggkggslp rsatpgppge
1441 hlvngrmdfa fpgstnslhr mtttsaaayg thlsphvphr vlstsstltr dynsltrseh
1501 shsttlprdy stltsvsshd srltagvpdt ptrlvfsalg ptslrvswqe prcerplqgy
1561 sveyqllngg elhrinipnp aqtsvvvedl lpnhsyvfrv raqsqegwgr eregvities
1621 qvhpqsplcp lpgsaftlst psapgplvft alspdslqls werprrpngd ivgylvtcem
1681 aqgggpataf rvdgdspesr ltvpglsenv pykfkvqart tegfgpereg iitiesqdgg
1741 pfpqlgsrag lfqhplqsey ssittthtsa tepflvdglt lgaqhleagg sltrhvtqef
1801 vsrtlttsgt lsthmdqqff qt
```

Protein sequence isoform 2 (SEQ ID NO (93)):

```
   1 magprpspwa rlllaalisv slsgtlanrc kkapvkscte cvrvdkdcay ctdemfrdrr
  61 cntqaellaa gcqresivvm essfqiteet qidttlrrsq mspqglrvrl rpgeerhfel
 121 evfeplespv dlyilmdfsn smsddldnlk kmgqnlarvl sqltsdytig fgkfvdkvsv
 181 pqtdmrpekl kepwpnsdpp fsfknvislt edvdefrnkl qgerisgnld apeggfdail
 241 qtavctrdig wrpdsthllv fstesafhye adganvlagi msrnderchl dttgtytqyr
 301 tqdypsvptl vrllakhnii pifavtnysy syyeklhtyf pvsslgvlqe dssnivelle
 361 eafnrrirsnl diraldsprg lrtevtskmf qktrtgsfhi rrgevgiyqv qlralehvdg
 421 thvcqlpedq kgnihlkpsf sdglkmdagi icdvctcelq kevrsarcsf ngdfvcgqcv
 481 csegwsgqtc ncstgslsdi qpclregedk pcsgrgecqc ghcvcygegr yegqfceeydn
 541 fqcprtsgfl cndrgrcsmg qcvcepgwtg pscdcplsna tcidsnggic ngrghceecgr
 601 chchqqslyt dticeinysa ihpglcedlr scvqcqawgt gekkgrtcee cnfkvkmvde
 661 lkraeeevvvr csfrdedddc tysytmegdg apgpnstvlv hkkkdcppgs fwwliplll
 721 llpllalll lcwkycacck aclallpccn rghmvgfked hymlrenlma sdhldtpmlr
 781 sgnlkgrdvv rwkvtnnmqr pgfathaasi nptelvpygl slrlarlcte nllkpdtrec
 841 aqlrqeveen lnevyrqisg vhklqqtkfr qqpnagkkqd htivdtvlma prsakpallk
 901 ltekqveqra fhdlkvapgy ytltadqdar gmvefqegve lvdvrvplfi rpedddekql
 961 lveaidvpag tatlgrrlvn itiikeqard vvsfeqpefs vsrgdqvari pvirrvldgg
1021 ksqvsyrtqd gtaqgnrdyi pvegellfqp geawkelqvk llelqevdsl lrgrqvrrfh
1081 vqlsnpkfga hlgqphstti iirdpdeldr sftsqmlssq ppphgdlgap qnpnakaags
1141 rkihfnwlpp sgkpmgyrvk ywiqgdsese ahlldskvps veltnlypyc dyemkvcayg
1201 aqgegpyssl vscrthqevp sepgrlafnv vsstvtqlsw aepaetngei tayevcyglv
1261 nddnrpigpm kkvlvdnpkn rmllienlre sqpyrytvka rngagwgper eaiinlatqp
1321 krpmsipiip dipivdaqsg edydsflmys ddvlrspsgs qrpsvsddte hlvngrmdfa
1381 fpgstnslhr mtttsaaayg thlsphvphr vlstsstltr dynsltrseh shsttlprdy
1441 stltsvsshg lppiwehgrs rlplswalgs rsraqmkgfp psrgprdsii lagrpaapsw
1501 gpdsrltagv pdtptrlvfs algptslrvs wqeprcerpl qgysveyqll nggelhrini
1561 pnpaqtsvvv edllpnhsyv frvraqsqeg wgreregvit iesqvhpqsp lcplpgsaft
1621 lstpsapgpl vftalspdsl qlswerprrp ngdivgylvt cemaqgggpa tafrvdgdsp
1681 esrltvpgls envpykfkvq arttegfgpe regiitiesq dggpfpqlgs raglfqhplq
1741 seyssittth tsatepflvd gltlgaqhle aggsltrhvt qefvsrtltt sgtlsthmdq
1801 qffqt
```

Protein sequence isoform 3 (SEQ ID NO (94)):

```
   1 magprpspwa rlllaalisv slsgtlanrc kkapvkscte cvrvdkdcay ctdemfrdrr
  61 cntqaellaa gcqresivvm essfqiteet qidttlrrsq mspqglrvrl rpgeerhfel
 121 evfeplespv dlyilmdfsn smsddldnlk kmgqnlarvl sqltsdytig fgkfvdkvsv
 181 pqtdmrpekl kepwpnsdpp fsfknvislt edvdefrnkl qgerisgnld apeggfdail
 241 qtavctrdig wrpdsthllv fstesafhye adganvlagi msrnderchl dttgtytqyr
 301 tqdypsvptl vrllakhnii pifavtnysy syyeklhtyf pvsslgvlqe dssnivelle
 361 eafnrrirsnl diraldsprg lrtevtskmf qktrtgsfhi rrgevgiyqv qlralehvdg
 421 thvcqlpedq kgnihlkpsf sdglkmdagi icdvctcelq kevrsarcsf ngdfvcgqcv
 481 csegwsgqtc ncstgslsdi qpclregedk pcsgrgecqc ghcvcygegr yegqfceeydn
```

TABLE 2-continued

```
 541 fqcprtsgfl cndrgrcsmg qcvcepgwtg pscdcplsna tcidsnggic ngrghcecgr
 601 chchqqslyt dticeinysa ihpglcedlr scvqcqawgt gekkgrtcee cnfkvkmvde
 661 lkraeevvvr csfrdedddc tysytmegdg apgpnstvlv hkkkdcppgs fwwliplll l
 721 llpllalll l lcwkycacck aclallpccn rghmvgfked hymlrenlma sdhldtpmlr
 781 sgnlkgrdvv rwkvtnnmqr pgfathaasi nptelvpygl slrlarlcte nllkpdtrec
 841 aqlrqeveen lnevyrqisg vhklqqtkfr qqpnagkkqd htivdtvlma prsakpallk
 901 ltekqveqra fhdlkvapgy ytltadqdar gmvefqegve lvdvrvplfi rpedddekql
 961 lveaidvpag tatlgrrlvn itiikeqard vvsfeqpefs vsrgdqvari pvirrvldgg
1021 ksqvsyrtqd gtaqgnrdyi pvegellfqp geawkelqvk llelqevdsl lrgrqvrrfh
1081 vqlsnpkfga hlgqphstti iirdpdeldr sftsqmlssq ppphgdlgap qnpnakaags
1141 rkihfnwlpp sgkpmgyrvk ywiqgdsese ahlldskvps veltnlypyc dyemkvcayg
1201 aqgegpyssl vscrthqevp sepgrlafnv vsstvtqlsw aepaetngei tayevcyglv
1261 nddnrpigpm kkvlvdnpkn rmllienlre sqpyrytvka rngagwgper eaaiinlatqp
1321 krpmsipiip dipivdaqsg edydsflmys ddvlrspsgs qrpsvsddte hlvngrmdfa
1381 fpgstnslhr mtttsaaayg thlsphvphr vlstsstltr dynsltrseh shsttlprdy
1441 stltsysshd srltagvpdt ptrlvfsalg ptslrvswqe prcerplqgy sveyqllngg
1501 elhrininipnp aqtsvvvedl lpnhsyvfrv raqsqegwgr eregvities qvhpgvsplcp
1561 lpgsaftlst psapgplvft alspdslqls werprrpngd ivgylvtcem aqgggpataf
1621 rvdgdspesr ltvpglsenv pykfkvqart tegfgpereg iitiesqdgg pfpqlgsrag
1681 lfqhplqsey ssitththtsa tepflvdglt lgaqhleagg sltrhvtqef vsrtlttsgt
1741 lsthmdqqff qt
```

Gene ID:
Y22

Gene symbol:
PVRL4

Gene description:
Poliovirus receptor-related protein 4

Unigene:
Hs.492490

Genbank:
BC010423

Entrez Gene:
81607

Refseq:
NM_030916

Protein sequence (SEQ ID NO (95)):
```
   1 mplslgaemw gpeawlllll llasftgrcp ageletsdvv tvvlgqdakl pcfyrgdsge
  61 qvgqvawarv dagegaqela llhskyglhv spayegrveq ppppprnpldg svllrnavqa
 121 degeyecrvs tfpagsfqar lrlrvlvppl pslnpgpale egqgltlaas ctaegspaps
 181 vtwdtevkgt tssrsfkhsr saavtsefhl vpsrsmngqp ltcvvshpgl lqddqrithil
 241 hvsflaeasv rgledqnlwh igregamlkc lsegqpppsy nwtrldgplp sgvrvdgdtl
 301 gfppplttehs giyvchvsne fssrdsqvtv dvldpqegwg kqvdlvsasv hpgviaall
 361 fcllvvvvvl msryhrrkaq qmtqkyeeel tltrensirr lhshhtdprs qpeesvglra
 421 eghpdslkdn sscsvmseep egrsystltt vreietqtel lspgsgraee eedqdegikq
 481 amnhfvqeng tlrakptgng iyingrghlv
```

Gene ID:
Y23

Gene symbol:
SDC1

Gene description:
Syndecan-1

Unigene:
Hs.224607

Genbank:
BC008765

Entrez Gene:
6382

Refseq:
NM_001006946

Protein sequence (SEQ ID NO (96)):
```
   1 mrraalwlwl calalslqpa lpqivatnlp pedqdgsgdd sdnfsgsgag alqditlsqq
  61 tpstwkdtql ltaiptspep tgleataast stlpagegpk egeavvlpev epgltareqe
 121 atprprettq lptthqastt tattaqepat shprdmqpg hhetstpagp sqadlhtpht
 181 edggpsater aaedgassql paaegsgeqd ftfetsgent avvavepdrr nqspvdggat
```

TABLE 2-continued

```
241 gasqglldrk evlggviagg lvglifavcl vgfmlyrmkk kdegsyslee pkqanggayq
301 kptkqeefya
```

Gene ID:
Z1

Gene symbol:
ENPP1

Gene description:
Ectonucleotide pyrophosphatase/phosphodiesterase family member 1

Unigene:
Hs.527295

Genbank:
BC059375

Entrez Gene:
5167

Refseq:
NM_006208

Protein sequence (SEQ ID NO (97)):
```
  1 merdgcaggg srggeggrap regpagngrd rgrshaaeap gdpqaaasll apmdvgeepl
 61 ekaarartak dpntykvlsl vlsvcvltti lgcifglkps cakevksckg rcfertfgnc
121 rcdaacvelg nccldyqetc iepehiwtcn kfrcgekrlt rslcacsddc kdkgdcciny
181 ssvcqgeksw veepcesine pqcpagfetp ptllfsldgf raeylhtwgg llpvisklkk
241 cgtytknmrp vyptktfpnh ysivtglype shgiidnkmy dpkmnasfsl kskekfnpew
301 ykgepiwvta kyqglksgtf fwpgsdvein gifpdiykmy ngsvpfeeri lavlqwlqlp
361 kderphfytl yleepdssgh sygpvssevi kalqrvdgmv gmlmdglkel nlhrclnlil
421 isdhgmeqgs ckkyiylnky lldykniкvi ygpaarlrps dvpdkyysfn yegiarnlsc
481 repnqhfkpy lkhflpkrlh faksdriepl tfyldpqwql alnpserkyc gsgfhgsdnv
541 fsnmqalfvg ygpgfkhgie adtfenievy nlmcdllnlt papnngthgs lnhllknpvy
601 tpkhpkevhp lvqcpftrnp rdnlgcscnp silpiedfqt qfnltvaeek iikhetlpyg
661 rprvlqkent icllsqhqfm sgysqdilmp lwtsytvdrn dsfstedfsn clyqdfripl
721 spvhkcsfyk nntkvsygfl sppqlnknss giyseallтt nivpmyqsfq viwryfhdtl
781 lrkyaeerng vnvvsgpvfd fdydgrcdsl enlrqkrrvi rnqeilipth ffivltsckd
841 tsqtplhcen ldtlafilph rtdnsescvh gkhdsswvee llmlhrarit dvehitglsf
901 yqqrkepvsd ilklkthlpt fsqed
```

Gene ID:
Z2

Gene symbol:
CD34

Gene description:
Hematopoietic progenitor cell antigen CD34

Unigene:
Hs.374990

Genbank:
M81104

Entrez Gene:
947

Refseq:
NM_001773|NM_001025109

Protein sequence isoform b (SEQ ID NO (98)):
```
  1 mlvrrgarag prmprgwtal cllsllpsgf msldnngtat pelptqgtfs nvstnvsyqe
 61 tttpstlgst slhpvsqhgn eattnitett vkftstsvit svygntnssv qsqtsvistv
121 fttpanvstp ettlkpslsp gnvsdlstts tslatsptkp ytssspilsd ikaeikcsgi
181 revkltqgic leqnktssca efkkdrgegl arvlcgeeqa dadagaqvcs lllaqsevrp
241 qclllvlanr teissklqlm kkhqsdlkkl gildfteqdv ashqsysqkt lialvtsgal
301 lavlgitgyf lmnrrswspt gerlelep
```

Protein sequence isoform a (SEQ ID NO (99)):
```
  1 mlvrrgarag prmprgwtal cllsllpsgf msldnngtat pelptqgtfs nvstnvsyqe
 61 tttpstlgst slhpvsqhgn eattnitett vkftstsvit svygntnssv qsqtsvistv
121 fttpanvstp ettlkpslsp gnvsdlstts tslatsptkp ytssspilsd ikaeikcsgi
181 revkltqgic leqnktssca efkkdrgegl arvlcgeeqa dadagaqvcs lllaqsevrp
241 qclllvlanr teissklqlm kkhqsdlkkl gildfteqdv ashqsysqkt lialvtsgal
301 lavlgitgyf lmnrrswspt gerlgedpyy tengggqgys sgpgtspeaq gkasvnrgaq
361 engtgqatsr nghsarqhvv adtel
```

TABLE 2-continued

Gene ID:
Z3

Gene symbol:
JAM3

Gene description:
Junctional adhesion molecule C

Unigene:
Hs.150718

Genbank:
BC012147

Entrez Gene:
83700

Refseq:
NM_032801|NM_001205329

Protein sequence isoform 1 (SEQ ID NO (100)):
```
  1 malrrpprlr lcarlpdffl lllfrgclig avnlkssnrt pvvqefesve lsciitdsqt
 61 sdpriewkki qdeqttyvff dnkiqgdlag raeilgktsl kiwnvtrrds alyrcevvar
121 ndrkeideiv ieltvqvkpv tpvcrvpkav pvgkmatlhc qeseghprph yswyrndvpl
181 ptdsranprf rnssfhlnse tgtivftavh kddsgqyyci asndagsarc eeqemevydl
241 niggiiggvl vvlavlalit lgiccayrrg yfinnkqdge syknpgkpdg vnyirtdeeg
301 dfrhkssfvi
```

Protein sequence isoform 2 (SEQ ID NO (101)):
```
  1 malrrpprlr lcarlpdffl lllfrgclig avnlkssnrt pvvqefesve lsciitdsqt
 61 sdpriewkki qdeqttyvff dnkiqvkpvt pvcrvpkavp vgkmatlhcq eseghprphy
121 swyrndvplp tdsranprfr nssfhlnset gtivftavhk ddsgqyycia sndagsarce
181 eqemevydln iggiiggvlv vlavlalitl giccayrrgy finnkqdges yknpgkpdgv
241 nyirtdeegd frhkssfvi
```

Gene ID:
Z4

Gene symbol:
CD14

Gene description:
Monocyte differentiation antigen CD14

Unigene:
Hs.163867

Genbank:
BC010507

Entrez Gene:
929

Refseq:
NM_000591

Protein sequence (SEQ ID NO (102)):
```
  1 merasclll lllplvhvsat tpepceldde dfrcvcnfse pqpdwseafq cvsaveveih
 61 agglnlepfl krvdadadpr qyadtvkalr vrrltvgaaq vpaqllvgal rvlaysrlke
121 ltledlkitg tmpplpleat glalsslrlr nvswatgrsw laelqqwlkp glkvlsiaqa
181 hspafsceqv rafpaltsld lsdnpglger glmaalcphk fpaiqnlalr ntgmetptgv
241 caalaaagvq phsldlshns lratvnpsap rcmwssalns lnlsfagleq vpkglpaklr
301 vldlscnrln rapqpdelpe vdnltldgnp flvpgtalph egsmnsgvvp acarstlsvg
361 vsgtlvllqg argfa
```

Gene ID:
Z5

Gene symbol:
PLSCR4

Gene description:
Phospholipid scramblase 4

Unigene:
Hs.477869

Genbank:
AF199023

TABLE 2-continued

Entrez Gene:
57088

Refseq:
NM_001128304|NM_001128306|NM_001177304

Protein sequence isoform a (SEQ ID NO (103)):
```
  1 msgvvptape qpagemenqt kppdprpdap peynshflpg ppgtavpppt gypgglpmgy
 61 yspqqpstfp lyqpvggihp vryqpgkypm pnqsvpitwm pgptpmancp pgleylvqld
121 nihvlqhfep lemmtcfetn nrydiknnsd qmvyivtedt ddftrnayrt lrpfvlrvtd
181 cmgreimtmq rpfrctcccf ccpsarqele vqcppgvtig fvaehwnlcr avysiqnekk
241 envmrvrgpc stygcgsdsv fevksldgis nigsiirkwn gllsamadad hfdihfpldl
301 dvkmkamifg acflidfmyf ersppqrsr
```

Protein sequence isoform b (SEQ ID NO (104)):
```
  1 msgvvptape qpagemenqt kppdprpdap peynshflpg ppgtavpppt gypgglpmgy
 61 yspqqpstfp lyqpvggihp vryqpgkypm pnqsvpitwm pgptpmancp pgleylvqle
121 vqcppgvtig fvaehwnlcr avysiqnekk envmrvrgpc stygcgsdsv fevksldgis
181 nigsiirkwn gllsamadad hfdihfpldl dvkmkamifg acflidfmyf ersppqrsr
```

Protein sequence isoform c (SEQ ID NO (105)):
```
  1 menqtkppdp rpdappeyns hflpgppgta vpppthgypgg lpmgyyspqq pstfplyqpv
 61 ggihpvryqp gkypmpnqsv pitwmpgptp mancppgley lvqlevqcpp gvtigfvaeh
121 wnlcravysi qnekkenvmr vrgpcstygc gsdsvfevks ldgisnigsi irkwngllsa
181 madadhfdih fpldldvkmk amifgacfli dfmyferspp qrsr
```

Gene ID:
Z6

Gene symbol:
AMOT

Gene description:
angiomotin

Unigene:
Hs.528051

Genbank:
AF286598

Entrez Gene:
154796

Refseq:
NM_133265|NM_001113490

Protein sequence isoform 2 (SEQ ID NO (106)):
```
  1 mpraqpssas yqpvpadpfa ivsraqqmve ilsdenrnlr qelegcyekv arlqkvetei
 61 qrvseayenl vksssskreal ekamrnkleg eirrmhdfnr dlrerletan kqlaekeyeg
121 sedtrktisq lfaknkesqr ekekleaela tarstnedqr rhieirdqal snaqakvvkl
181 eeelkkkqvy vdkvekmqqa lvqlqaacek reqlehrlrt rlereleslr iqqrqgncqp
241 tnvseynaaa lmellrekee rilaleadmt kweqkyleen vmrhfaldaa atvaaqrdtt
301 vishspntsy dtaleariqk eeeeilmank rcldmegrik tlhaqiiekd amikvlqqrs
361 rkepskteql scmrpakslm sisnagsgll shssstltgsp imeekrddks wkgslgillg
421 gdyraeyvps tpspvppstp llsahsktgs rdcstqterg tesnktaava pisvpapvaa
481 aataaaitat aatitttmva aapvavaaaa apaaaaapsp ataaataaav spaaagqipa
541 aasvasaaav apsaaaaaav qvapaapapv papalvpvpa paaaqasapa qtqaptsapa
601 vaptpaptpt pavaqaevpa spatgpgphr lsipsltcnp dktdgpvfhs ntlerktpiq
661 ilgqepdaem veyli
```

Protein sequence isoform 1 (SEQ ID NO (107)):
```
  1 mrnseeqpsg gttvlqrllq eqlrygnpse nrsllaihqq atgngppfps gsgnpgpqsd
 61 vlspqdhhqq lvahaarqep qggeiqsenl imekqlsprm qnneelptye eakvqsqyfr
121 gqqhasvgaa fyvtgvtnqk mrtegrpsvq rlnpgkmhqd eglrdlkqgh vrslserlmq
181 mslatsgvka hppvtsapls ppqpndlykn ptsssefyka qgplpnqhsl kgmehrgppp
241 eypfkgmppq svvckpqepg hfysehrlnq pgrteqglmr yqhppeygaa rpaqdislpl
301 sarnsqphsp tssltsggsl pllqsppstr lsparhplvp nqqdhsahlp rpqqhflpnq
361 ahqgdhyrls qpglsqqqqq qqqhhhhhh hqqqqqqqpq qqpgeaysam praqpssasy
421 qpvpadpfai vsraqqmvei lsdenrnlrq elegcyekva rlqkveteiq rvseayenlv
481 kssskreale kamrnklege irrmhdfnrd lrerletank qlaekeyegs edtrktisql
541 faknkesqre kekleaelat arstnedqrr hieirdqals naqakvvkle eelkkkqvyv
601 dkvekmqqal vqlqaacekr eqlehrlrtr lereleslri qqrqgncqpt nvseynaaal
661 mellrekeer ilaleadmtk weqkyleenv mrhfaldaaa tvaaqrdttv ishspntsyd
721 taleariqke eeeilmankr cldmegrikt lhaqiiekda mikvlqqrsr kepskteqls
781 cmrpakslms isnagsglls hssstltgspi meekrddksw kgslgillgg dyraeyvpst
841 pspvppstpl lsahsktgsr dcstqtergt esnktaavap isvpapvaaa ataaaitata
901 atitttmvaa apvavaaaaa paaaaapspa taaataaavs paaagqipaa asvasaaava
961 psaaaaaavq vapaapapvp apalvpvpap aaaqasapaq tqaptsapav aptpaptptp
```

TABLE 2-continued

```
1021 avaqaevpas patgpgphrl sipsltcnpd ktdgpvfhsn tlerktpiqi lgqepdaemv
1081 eyli
```

Gene ID:
Z7

Gene symbol:
ENPEP

Gene description:
glutamyl aminopeptidase (aminopeptidase A)

Unigene:
Hs.435765

Genbank:
L12468

Entrez Gene:
2028

Refseq:
NM_001977

Protein sequence (SEQ ID NO (108)):
```
   1 mnfaeregsk ryciqtkhva ilcavvvgvg livglavglt rscdssgdgg pgtapapshl
  61 psstaspsgp paqdqdicpa sedesgqwkn frlpdfvnpv hydlhvkpll eedtytgtvs
 121 isinlsaptr ylwlhlretr itrlpelkrp sgdqvqvrrc feykkqeyvv veaeeeltps
 181 sgdglylltm efagwlngsl vgfyrttyte ngqvksivat dheptdarks fpcfdepnkk
 241 atytisithp keygalsnmp vakeesvddk wtrttfeksv pmstylvcfa vhqfdsvkri
 301 snsgkpltiy vqpeqkhtae yaanitksvf dyfeeyfamn yslpkldkia ipdfgtgame
 361 nwglityret nllydpkesa ssnqqrvatv vahelvhqwf gnivtmdwwe dlwlnegfas
 421 ffeflgvnha etdwqmrdqm lledvlpvqe ddslmsshpi ivtvttpdei tsvfdgisys
 481 kgssilrmle dwikpenfqk gcqmylekyq fknaktsdfw aaleeasrlp vkevmdtwtr
 541 qmgypvlnvn gvknitqkrf lldpranpsq ppsdlgytwn ipvkwtedni tssvlfnrse
 601 kegitlnssn psgnaflkin pdhigfyrvn yevatwdsia talslnhktf ssadraslid
 661 dafalaraql ldykvalnlt kylkreenfl pwqrvisavt yiismfeddk elypmieeyf
 721 qgqvkpiads lgwndagdhv tkllrssvlg fackmgdrea lnnasslfeq wlngtvslpv
 781 nlrllvyryg mqnsgneisw nytleqyqkt slaqekekll yglasvknvt llsryldllk
 841 dtnliktqdv ftviryisyn sygknmawnw iqlnwdylvn rytlnnrnlg rivtiaepfn
 901 telqlwqmes ffakypqaga gekpreqvle tvknniewlk qhrntirewf fnllesg
```

Gene ID:
Z8

Gene symbol:
THY1

Gene description:
Thy-1 cell surface antigen

Unigene:
Hs.644697

Genbank:
AP003396

Entrez Gene:
7070

Refseq:
NM_006288

Protein sequence (SEQ ID NO (109)):
```
   1 mnlaisiall ltvlqvsrgq kvtsltaclv dqslrldcrh entssspiqy efsltretkk
  61 hvlfgtgvp ehtyrsrtnf tskynmkvly lsaftskdeg tytcalhhsg hsppissqnv
 121 tvlrdklvkc egisllaqnt swlllllsl sllqatdfms l
```

SEQUENCE LISTING (109 sequences)

SEQ ID NO: 1 - protein, 583 aa, Homo sapiens
MESKGASSCRLLFCLLISATVFRPGLGWYTVNSAYGDTIIIPCRLDVPQNLMFGKWKYEKPDGSPVFIAFRSSTKKSVQYDDVPEYKDRLNLSENYTLSISNARISDEKRFVCMLVTEDNVFEAPTIVKVFKQPSKPEIVSKALFLETEQLKKLGDCISEDSYPDGNITWYRNGKVLHPLEGAVVIIFKKEMDPVTQLYTMTSTLEYKTTKADIQMPFTCSVTYYGPSGQKTIHSEQAVFDIYYPTEQVTIQVLPPKNAIKEGDNITLKCLGNGNPPPEEFLFYLPGQPEGIRSSNTYTLTDVRRNATGDYKCSLIDKKSMIASTAITVHYLDLSLNPSGEVTRQIGDALPVSCTISASRNATVVWMKDNIRLRSSPSFSSLHYQDAGNYVCETALQEVEGLKKRESLTLIVEGKPQIKMTKKTDPSGLSKTIICHVEGFPKPAIQWTITGSGSVINQTEESPYINGRYYSKIIISPEENVTLTCTAENQLERTVNSLNVSAISIPEHDEADEISDENREKVNDQAKLIVGIVVGLLLAALVAGVVYWLYMKKSKTASKHVNKDLGNMEENKKLEENNHKTEA

SEQ ID NO: 2 - protein, 1023 aa, Homo sapiens
MGKGVGRDKYEPAAVSEQGDKKGKKGKKDRDMDELKKEVSMDDHKLSLDELHRKYGTDLSRGLTSARAAEILARDGPNALTPPPTTPEWIKFCRQLFGGFSMLLWIGAILCFLAYSIQAATEEEPQNDNLYLGVVLSAVVIITGCFSYYQEAKSSKIMESFKNMVPQQALVIRNGEKMSINAEEVVVGDLVEVKGGDRIPADLRIISANGCKVDNSSLTGESEPQTRSPDFTNENPLETRNIAFFSTNCVEGTARGIVVYTGDRTVMGRIATLASGLEGGQTPIAAEIEHFIHIITGVAVFLGVSFFILSLILEYTWLEAVIFLIGIIVANVPEGLLATVTVCLTLTAKRMARKNCLVKNLEAVETLGSTSTICSDKTGTLTQNRMTVAHMWFDNQIHEADTTENQSGVSFDKTSATWLALSRIAGLCNRAVFQANQENLPILKRAVAGDASESALLKCIELCCGSVKEMRERYAKIVEIPFNSTNKYQLSIHKNPNTSEPQHLLVMKGAPERILDRCSSILLHGKEQPLDEELKDAFQNAYLELGGLGERVLGFCHLFLPDEQFPEGFQFDTDDVNFPIDNLCFVGLISMIDPPRAAVPDAVGKCRSAGIKVIMVTGDHPITAKAIAKGVGIISEGNETVEDIAARLNIPVSQVNPRDAKACVVHGSDLKDMTSEQLDDILKYHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLIFIIANIPLPLGTVTILCIDLGTDMVPAISLAYEQAESDIMKRQPRNPKTDKLVNERLISMAYGQIGMIQALGGFFTYFVILAENGFLPIHLLGLRVDWDDRWINDVEDSYGQQWTYEQRKIVEFTCHTAFFVSIVVVQWADLVICKTRRNSVFQQGMKNKILIFGLFEETALAAFLSYCPGMGVALRMYPLKPTWWFCAFPYSLLIFVYDEVRKLIIRRRPGGWVEKETYY

SEQ ID NO: 3 - protein, 1023 aa, Homo sapiens
MAFKVGRDKYEPAAVSEQGDKKGKKGKKDRDMDELKKEVSMDDHKLSLDELHRKYGTDLSRGLTSARAAEILARDGPNALTPPPTTPEWIKFCRQLFGGFSMLLWIGAILCFLAYSIQAATEEEPQNDNLYLGVVLSAVVIITGCFSYYQEAKSSKIMESFKNMVPQQALVIRNGEKMSINAEEVVVGDLVEVKGGDRIPADLRIISANGCKVDNSSLTGESEPQTRSPDFTNENPLETRNIAFFSTNCVEGTARGIVVYTGDRTVMGRIATLASGLEGGQTPIAAEIEHFIHIITGVAVFLGVSFFILSLILEYTWLEAVIFLIGIIVANVPEGLLATVTVCLTLTAKRMARKNCLVKNLEAVETLGSTSTICSDKTGTLTQNRMTVAHMWFDNQIHEADTTENQSGVSFDKTSATWLALSRIAGLCNRAVFQANQENLPILKRAVAGDASESALLKCIELCCGSVKEMRERYAKIVEIPFNSTNKYQLSIHKNPNTSEPQHLLVMKGAPERILDRCSSILLHGKEQPLDEELKDAFQNAYLELGGLGERVLGFCHLFLPDEQFPEGFQFDTDDVNFPIDNLCFVGLISMIDPPRAAVPDAVGKCRSAGIKVIMVTGDHPITAKAIAKGVGIISEGNETVEDIAARLNIPVSQVNPRDAKACVVHGSDLKDMTSEQLDDILKYHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLIFIIANIPLPLGTVTILCIDLGTDMVPAISLAYEQAESDIMKRQPRNPKTDKLVNERLISMAYGQIGMIQALGGFFTYFVILAENGFLPIHLLGLRVDWDDRWINDVEDSYGQQWTYEQRKIVEFTCHTAFFVSIVVVQWADLVICKTRRNSVFQQGMKNKILIFGLFEETALAAFLSYCPGMGVALRMYPLKPTWWFCAFPYSLLIFVYDEVRKLIIRRRPGGWVEKETYY

SEQ ID NO: 4 - protein, 992 aa, Homo sapiens
MDELKKEVSMDDHKLSLDELHRKYGTDLSRGLTSARAAEILARDGPNALTPPPTTPEWIKFCRQLFGGFSMLLWIGAILCFLAYSIQAATEEEPQNDNLYLGVVLSAVVIITGCFSYYQEAKSSKIMESFKNMVPQQALVIRNGEKMSINAEEVVVGDLVEVKGGDRIPADLRIISANGCKVDNSSLTGESEPQTRSPDFTNENPLETRNIAFFSTNCVEGTARGIVVYTGDRTVMGRIATLASGLEGGQTPIAAEIEHFIHIITGVAVFLGVSFFILSLILEYTWLEAVIFLIGIIVANVPEGLLATVTVCLTLTAKRMARKNCLVKNLEAVETLGSTSTICSDKTGTLTQNRMTVAHMWFDNQIHEADTTENQSGVSFDKTSATWLALSRIAGLCNRAVFQANQENLPILKRAVAGDASESALLKCIELCCGSVKEMRERYAKIVEIPFNSTNKYQLSIHKNPNTSEPQHLLVMKGAPERILDRCSSILLHGKEQPLDEELKDAFQNAYLELGGLGERVLGFCHLFLPDEQFPEGFQFDTDDVNFPIDNLCFVGLISMIDPPRAAVPDAVGKCRSAGIKVIMVTGDHPITAKAIAKGVGIISEGNETVEDIAARLNIPVSQVNPRDAKACVVHGSDLKDMTSEQLDDILKYHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLIFIIANIPLPLGTVTILCIDLGTDMVPAISLAYEQAESDIMKRQPRNPKTDKLVNERLISMAYGQIGMIQALGGFFTYFVILAENGFLPIHLLGLRVDWDDRWINDVEDSYGQQWTYEQRKIVEFTCHTAFFVSIVVVQWADLVICKTRRNSVFQQGMKNKILIFGLFEETALAAFLSYCPGMGVALRMYPLKPTWWFCAFPYSLLIFVYDEVRKLIIRRRPGGWVEKETYY

SEQ ID NO: 5 - protein, 294 aa, Homo sapiens
MERLTLTRTIGGPLLTATLLGKTTINDYQVIRMPFSHLSTYSLVWVMAAVVLCTAQVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKGYWFSVPLLLSIVSLVILLVLISILLYWKRHRNQDREP

SEQ ID NO: 6 - protein, 269 aa, Homo sapiens
MERLVIRMPFSHLSTYSLVWVMAAVVLCTAQVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKGYWFSVPLLLSIVSLVILLVLISILLYWKRHRNQDREP

SEQ ID NO: 7 - protein, 1786 aa, Homo sapiens
MGLLQLLAFSFLALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRACDCDPRGIETPQCDQSTGQCVCVEGVEGPRCDKCTRGYSGVFPDCTPCHQCFALWDVIIAELTNRTHRFLEKAKALKISGVIGPYRETVDSVERKVSEIKDILAQSPAAEPLKNIGNLFEEAEKLIKDVTEMMAQVEVKLSDTTSQSNSTAKELDSLQTEAESLDNTVKELAEQLEFIKNSDIRGALDSITKYFQMSLEAEERVNASTTEPNSTVEQSALMRDRVEDVMMERESQFKEKQEEQARLLDELAGKLQSLDLSAAAEMTCGTPPGASCSETECGGPNCRTDEGERKCGGPGCGGLVTVAHNAWQKAMDLDQDVLSALAEVEQLSKMVSEAKLRADEAKQSAEDILLKTNATKEKMDKSNEELRNLIKQIRNFLTQDSADLDSIEAVANEVLKMEMPSTPQQLQNLTEDIRERVESLSQVEVILQHSAADIARAEMLLEEAKRASKSATDVKVTADMVKEALEEAEKAQVAAEKAIKQADEDIQGTQNLLTSIESETAASEETLFNASQRISELERNVEELKRKAAQNSGEAEYIEKVVYTVKQSAEDVKKTLDGELDEKYKKVENLIAKKTEESADARRKAEMLQNEAKTLLAQANSKLQLLKDLERKYEDNQRYLEDKAQELARLEGEVRSLLKDISQKVAVYSTCL

SEQ ID NO: 8 - protein, 757 aa, Homo sapiens
MLLRLLLAWAAAGPTLGQDPWAAEPRAACGPSSCYALFPRRRTFLEAWRACRELGGDLATPRTPEEAQRVDSLVGAGPASRLLWIGLQRQARQCQLQRPLRGFTWTTGDQDTAFTNWAQPASGGPCPAQRCVALEASGEHRWLEGSCTLAVDGYLCQFGFEGACPALQDEAGQAGPAVYTTPFHLVSTEFEWLPFGSVAAVQCQAGRGASLLCVKQPEGGVGWSRAGPLCLGTGCSPDNGGCEHECVEEVDGHVSCRCTEGFRLAADGRSCEDPCAQAPCEQQCEPGGPQGYSCHCRLGFRPAEDDPHRCVDTDECQIAGVCQQMCVNYVGGFECYCSEGHELEADGISCSPAGAMGAQASQDLGDELLDDGEDEEDEDEAWKAFNGGWTEMPGILWMEPTQPPDFALAYRPSFPEDREPQIPYPEPTWPPPLSAPRVPYHSSVLSVTRPVVVSATHPTLPSAHQPPVIPATHPALSRDHQIPVIAANYPDLPSAYQPGILSVSHSAQPPAHQPPMISTKYPELFPAHQSPMFPDTRVAGTQTTTHLPGIPPNHAPLVTTLGAQLPPQAPDALVLRTQATQLPIIPTAQPSLTTTSRSPVSPAHQISVPAATQPAALPTLLPSQSPTNQTSPISPTHPHSKAPQIPREDGPSPKLALWLPSPAPTAAPTALGEAGLAEHSQRDDRWLLVALLVPTCVFLVVLLALGIVYCTRCGPHAPNKRITDCYRWVIHAGSKSPTEPMPPRGSLTGVQTCRTSV

SEQ ID NO: 9 - protein, 1690 aa, Homo sapiens
MHPGLWLLLVTLCLTEELAAAGEKSYGKPCGGQDCSGSCQCFPEKGARGRPGPIGIQGPTGPQGFTGSTGLSGLKGERGFPGLLGPYGPKGDKGPMGVPGFLGINGIPGHPGQPGPRGPPGLDGCNGTQGAVGFPGPDGYPGLLGPPGLPGQKGSKGDPVLAPGSFKGMKGDPGLPGLDGITGPQGAPGFPGAVGPAGPPGLQGPPGPPGPLGPDGNMGLGFQGEKGVKGDVGLPGPAGPPPSTGELEFMGFPKGKKGSKGEPGPKGFPGISGPPGFPGLGTTGEKGEKGEKGIPGLPGPRGPMGSEGVQGPPGQQGKKGTLGFPGLNGFQGIEGQKGDIGLPGPDVFIDIDGAVISGNPGDPGVPGLPGLKGDEGIQGLRGPSGVPGLPALSGVPGALGPQGFPGLKGDQGNPGRTTIGAAGLPGRDGLPGPPGPPGPPSPEFETETLHNKESGFPGLRGEQGPKGNLGLKGIKGDSGFCACDGGVPNTGPPGEPGPPGPWGLIGLPGLKGARGDRGSGGAQGPAGAPGLVGPLGPSGPKGKKGEPILSTIQGMPGDRGDSGSQGFRGVIGEPGKDGVPGLPGLPGLPGDGGQGFPGEKGLPGLPGEKGHPGPPGLPGNGLPGLPGPRGLPGDKGKDGLPGQQGLPGSKGITLPCIIPGSYGPSGFPGTPGFPGPKGSRGLPGTPGQPGSSGSKGEPGSPGLVHLPELPGFPGPRGEKGLPGFPGLPGKDGLPGMIGSPGLPGSKGATGDIFGAENGAPGEQGLQGLTGHKGFLGDSGLPGLKGVHGKPGLLGPKGERGSPGTPGQVGQPGTPGSSGPYGIKGKSGLPGAPGFPGISGHPGKKGTRGKKGPPGSIVKKGLPGLKGLPGNPGLVGLKGSPGSPGVAGLPALSGPKGEKGSVGFVGFPGIPGLPGIPGTRGLKGIPGSTGKMGPSGRAGTPGEKGDRGNPGPVGIPSPRRPMSNLWLKGDKGSQGSAGSNGFPGPRGDKGEAGRPGPPGLPGAPGLPGIIKGVSGKPGPPGFMGIRGLPGLKGSSGITGFPGMPGESGSQGIRGSPGLPGASGLPGLKGDNGQTVEISGSPGPKGQPGESGFKGTKGRDGLIGNIGFPGNKGEDGKVGVSGDVGLPGAPGFPGVAGMRGEPGLPGSSGHQGAIGPLGSPGLIGPKGFPGFPGLHGLNGLPGTKGTHGTPGPSITGVPGPAGLPGPKGEKGYPGIGIGAPGKPGLRGQKGDRGFPGLQGPAGLPGAPGISLPSLIAGQPGDPGRPGLDGERGRPGPAGPPGPPGPSSNQGDTGDPGFPGIPGPKGPKGDQGIPGFSGLPGELGLKGMRGEPGFMGTPGKVGPPGDPGFPGMKGKAGPRGSSGLQGDPGQTPTAEAVQVPPGPLGLPGIDGIPGLTGDPGAQGPVGLQGSKGLPGIPGKDGPSGLPGPPGALGDPGLPGLQGPPGFEGAPGQQGPFGMPGMPGQSMRVGYTLVKHSQSEQVPPCPIGMSQLWVGYSLLFVEGQEKAHNQDLGFAGSCLPRFSTMPFIYCNINEVCHYARRNDKSYWLSTTAPIPMMPVSQTQIPQYISRCSVCEAPSQAIAVHSQDITIPQCPLGWRSLWIGYSFLMHTAAGAEGGGQSLVSPGSCLEDFRATPFIECSGARGTCHYFANKYSFWLTTVEERQQFGELPVSETLKAGQLHTRVSRCQVCMKSL

SEQ ID NO: 10 - protein, 1691 aa, Homo sapiens
MLINKLWLLLVTLCLTEELAAAGEKSYGKPCGGQDCSGSCQCFPEKGARGRPGPIGIQGPTGPQGFTGSTGLSGLKGERGFPGLLGPYGPKGDKGPMGVPGFLGINGIPGHPGQPGPRGPPGLDGCNGTQGAVGFPGPDGYPGLLGPPGLPGQKGSKGDPVLAPGSFKGMKGDPGLPGLDGITGPQGAPGFPGAVGPAGPPGLQGPPGPPGPLGPDGNMGLGFQGEKGVKGDVGLPGPAGPPPSTGELEFMGFPKGKKGSKGEPGPKGFPGISGPPGFPGLGTTGEKGEKGEKGIPGLPGPRGPMGSEGVQGPPGQQGKKGTLGFPGLNGFQGIEGQKGDIGLPGPDVFIDIDGAVISGNPGDPGVPGLPGLKGDEGIQGLRGPSGVPGLPALSGVPGALGPQGFPGLKGDQGNPGRTTIGAAGLPGRDGLPGPPGPPGPPSPEFETETLHNKESGFPGLRGEQGPKGNLGLKGIKGDSGFCACDGGVPNTGPPGEPGPPGPWGLIGLPGLKGARGDRGSGGAQGPAGAPGLVGPLGPSGPKGKKGEPILSTIQGMPGDRGDSGSQGFRGVIGEPGKDGVPGLPGLPGLPGDGGQGFPGEKGLPGLPGEKGHPGPPGLPGNGLPGLPGPRGLPGDKGKDGLPGQQGLPGSKGITLPCIIPGSYGPSGFPGTPGFPGPKGSRGLPGTPGQPGSSGSKGEPGSPGLVHLPELPGFPGPRGEKGLPGFPGLPGKDGLPGMIGSPGLPGSKGATGDIFGAENGAPGEQGLQGLTGHKGFLGDSGLPGLKGVHGKPGLLGPKGERGSPGTPGQVGQPGTPGSSGPYGIKGKSGLPGAPGFPGISGHPGKKGTRGKKGPPGSIVKKGLPGLKGLPGNPGLVGLKGSPGSPGVAGLPALSGPKGEKGSVGFVGFPGIPGLPGIPGTRGLKGIPGSTGKMGPSGRAGTPGEKGDRGNPGPVGIPSPRRPMSNLWLKGDKGSQGSAGSNGFPGPRGDKGEAGRPGPPGLPGAPGLPGIIKGVSGKPGPPGFMGIRGLPGLKGSSGITGFPGMPGESGSQGIRGSPGLPGASGLPGLKGDNGQTVEISGSPGPKGQPGESGFKGTKGRDGLIGNIGFPGNKGEDGKVGVSGDVGLPGAPGFPGVAGMRGEPGLPGSSGHQGAIGPLGSPGLIGPKGFPGFPGLHGLNGLPGTKGTHGTPGPSITGVPGPAGLPGPKGEKGYPGIGIGAPGKPGLRGQKGDRGFPGLQGPAGLPGAPGISLPSLIAGQPGDPGRPGLDGERGRPGPAGPPGPPGPSSNQGDTGDPGFPGIPGPKGPKGDQGIPGFSGLPGELGLKGMRGEPGFMGTPGKVGPPGDPGFPGMKGKAGPRGSSGLQGDPGQTPTAEAVQVPPGPLGLPGIDGIPGLTGDPGAQGPVGLQGSKGLPGIPGKDGPSGLPGPPGALGDPGLPGLQGPPGFEGAPGQQGPFGMPGMPGQSMRVGYTLVKHSQSEQVPPCPIGMSQLWVGYSLLFVEGQEKAHNQDLGFAGSCLPRFSTMPFIYCNINEVCHYARRNDKSYWLSTTAPIPMMPVSQTQIPQYISRCSVCEAPSQAIAVHSQDITIPQCPLGWRSLWIGYSFLMHTAAGAEGGGQSLVSPGSCLEDFRATPFIECSGARGTCHYFANKYSFWLTTVEERQQFGELPVSETLKAGQLHTRVSRCQVCMKSL

SEQ ID NO: 11 - protein, 1072 aa, Homo sapiens
MLRMRTAGWARGWCLGCCLLLPLSLSLAAAKQLLRYRLAEEGPADVRIGNVASDLGIVTGSGEVTFSLESGSEYLKIDNLTGELSTSERRIDREKLPQCQMIFDENECFLDFEVSVIGPSQSWVDLFEGQVIVLDINDNTPTFPSPVLTLTVEENRPVGTLYLLPTATDRDFGRNGIERYELLQEPGGGGSGGESRRAGAADSAPYPGGGGNGASGGGSGGSKRRLDASEGGGGTNPGGRSSVFELQVADTPDGEKQPQLIVKGALDREQRDSYELTLRVRDGGDPPRSSQAILRVLITDVNDNSPRFEKSVYEADLAENSAPGTPILQLRAADLDVGVNGQIEYVFGAATESVRRLLRLDETSGWLSVLHRIDREEVNQLRFTVMARDRGQPPKTDKATVVLNIKDENDNVPSIEIRKIGRIPLKDGVANVAEDVLVDTPIALVQVSDRDQGENGVVTCTVVGDVPFQLKPASDTEGDQNKKKYFLHTSTPLDYEATREFNVVIVAVDSGSPSLSSNNSLIVKVGDTNDNPPMFGQSVVEVYFPENNIPGERVATVLATDADSGKNAEIAYSLDSSVMGIFAIDPDSGDILVNTVLDREQTDRYEFKVNAKDKGIPVLQGSTTVIVQVADKNDNDPKFMQDVFTFYVKENLQPNSPVGMVTVMDADKGRNAEMSLYIEENNNIFSIENDTGTIYSTMSFDREHQTTYTFRVKAVDGGDPPRSATATVSLFVMDENDNAPTVTLPKNISYTLLPPSSNVRTVVATVLATDSDDGINADLNYSIVGGNPFKLFEIDPTSGVVSLVGKLTQKHYGLHRLVVQVNDSGQPSQSTTTLVHVFVNESVSNATAIDSQIARSLHIPLTQDIAGDPSYEISKQRLSIVIGVVAGIMTVILIILIVVMARYCRSKNKNGYEAGKKDHEDFFTPQQHDKSKKPKKDKKNKKSKQPLYSSIVTVEASKPNGQRYDSVNEKLSDSPSMGRYRSVNGGPGSPDLARHYKSSSPLPTVQLHPQSPTAGKKHQAVQDLPPANTFVGAGDNISIGSDHCSEYSCQTNNKYSKQVRCIPNIFKYPREG

SEQ ID NO: 12 - protein, 1069 aa, Homo sapiens
MLRMRTAGWARGWCLGCCLLLPLSLSLAAAKQLLRYRLAEEGPADVRIGNVASDLGIVTGSGEVTFSLESGSEYLKIDNLTGELSTSERRIDREKLPQCQMIFDENECFLDFEVSVIGPSQSWVDLFEGQVIVLDINDNTPTFPSPVLTLTVEENRPVGTLYLLPTATDRDFGRNGIERYELLQEPGGGGSGGESRRAGAADSAPYPGGGGNGASGGGSGGSKRRLDASEGGGGTNPGGRSSVFELQVADTPDGEKQPQLIVKGALDREQRDSYELTLRVRDGGDPPRSSQAILRVLITDVNDNSPRFEKSVYEADLAENSAPGTPILQLRAADLDVGVNGQIEYVFGAATESVRRLLRLDETSGWLSVLHRIDREEVNQLRFTVMARDRGQPPKTDKATVVLNIKDENDNVPSIEIRKIGRIPLKDGVANVAEDVLVDTPIALVQVSDRDQGENGVVTCTVVGDVPFQLKPASDTEGDQNKKKYFLHTSTPLDYEATREFNVVIVAVDSGSPSLSSNNSLIVKVGDTNDNPPMFGQSVVEVYFPENNIPGERVATVLATDADSGKNAEIAYSLDSSVMGIFAIDPDSGDILVNTVLDREQTDRYEFKVNAKDKGIPVLQGSTTVIVQVADKNDNDPKFMQDVFTFYVKENLQPNSPVGMVTVMDADKGRNAEMSLYIEENNNIFSIENDTGTIYSTMSFDREHQTTYTFRVKAVDGGDPPRSATATVSLFVMDENDNAPTVTLPKNISYTLLPPSSNVRTVVATVLATDSDDGINADLNYSIVGGNPFKLFEIDPTSGVVSLVGKLTQKHYGLHRLVVQVNDSGQPSQSTTTLVHVFVNESVSNATAIDSQIARSLHIPLTQDIAGDPSYEISKQRLSIVIGVVAGIMTVILIILIVVMARYCRSKNKNGYEAGKKDHEDFFTPQQHDKSKKPKKDKKNKKSKQPLYSSIVTVEASKPNGQRYDSVNEKLSDSPSMGRYRSVNGGPGSPDLARHYKSSSPLPTVQLHPQSPTAGKKHQAVQDLPPANTFVGAGDNISIGSDHCSEYSCQTNNKYSKQMRLHPYITVFG

SEQ ID NO: 13 - protein, 1247 aa, Homo sapiens
MLRMRTAGWARGWCLGCCLLLPLSLSLAAAKQLLRYRLAEEGPADVRIGNVASDLGIVTGSGEVTFSLESGSEYLKIDNLTGELSTSERRIDREKLPQCQMIFDENECFLDFEVSVIGPSQSWVDLFEGQVIVLDINDNTPTFPSPVLTLTVEENRPVGTLYLLPTATDRDFGRNGIERYELLQEPGGGGSGGESRRAGAADSAPYPGGGGNGASGGGSGGSKRRLDASEGGGGTNPGGRSSVFELQVADTPDGEKQPQLIVKGALDREQRDSYELTLRVRDGGDPPRSSQAILRVLITDVNDNSPRFEKSVYEADLAENSAPGTPILQLRAADLDVGVNGQIEYVFGAATESVRRLLRLDETSGWLSVLHRIDREEVNQLRFTVMARDRGQPPKTDKATVVLNIKDENDNVPSIEIRKIGRIPLKDGVANVAEDVLVDTPIALVQVSDRDQGENGVVTCTVVGDVPFQLKPASDTEGDQNKKKYFLHTSTPLDYEATREFNVVIVAVDSGSPSLSSNNSLIVKVGDTNDNPPMFGQSVVEVYFPENNIPGERVATVLATDADSGKNAEIAYSLDSSVMGIFAIDPDSGDILVNTVLDREQTDRYEFKVNAKDKGIPVLQGSTTVIVQVADKNDNDPKFMQDVFTFYVKENLQPNSPVGMVTVMDADKGRNAEMSLYIEENNNIFSIENDTGTIYSTMSFDREHQTTYTFRVKAVDGGDPPRSATATVSLFVMDENDNAPTVTLPKNISYTLLPPSSNVRTVVATVLATDSDDGINADLNYSIVGGNPFKLFEIDPTSGVVSLVGKLTQKHYGLHRLVVQVNDSGQPSQSTTTLVHVFVNESVSNATAIDSQIARSLHIPLTQDIAGDPSYEISKQRLSIVIGVVAGIMTVILIILIVVMARYCRSKNKNGYEAGKKDHEDFFTPQQHDKSKKPKKDKKNKKSKQPLYSSIVTVEASKPNGQRYDSVNEKLSDSPSMGRYRSVNGGPGSPDLARHYKSSSPLPTVQLHPQSPTAGKKHQAVQDLPPANTFVGAGDNISIGSDHCSEYSCQTNNKYSKQPFRRVTFSVVSQPQDPHQGSLQSCYDSGLEESETPSSKSSSGPRLGALPLPEDNYERTTPDGSVDSRPLPDVALTGKCTRECDEYGHSDSCWMPVRTSPERKKSQPKLSTFMPVDERGSQEKLANGEAAIMGDRNRNLLNKKLTSSYETFSAASFSKNEEANPEDIPLTKTGEYKPSPVNTLTRREVYL

SEQ ID NO: 14 - protein, 1255 aa, Homo sapiens
MLRMRTAGWARGWCLGCCLLLPLSLSLAAAKQLLRYRLAEEGPADVRIGNVASDLGIVTGSGEVTFSLESGSEYLKIDNLTGELSTSERRIDREKLPQCQMIFDENECFLDFEVSVIGPSQSWVDLFEGQVIVLDINDNTPTFPSPVLTLTVEENRPVGTLYLLPTATDRDFGRNGIERYELLQEPGGGGSGGESRRAGAADSAPYPGGGGNGASGGGSGGSKRRLDASEGGGGTNPGGRSSVFELQVADTPDGEKQPQLIVKGALDREQRDSYELTLRVRDGGDPPRSSQAILRVLITDVNDNSPRFEKSVYEADLAENSAPGTPILQLRAADLDVGVNGQIEYVFGAATESVRRLLRLDETSGWLSVLHRIDREEVNQLRFTVMARDRGQPPKTDKATVVLNIKDENDNVPSIEIRKIGRIPLKDGVANVAEDVLVDTPIALVQVSDRDQGENGVVTCTVVGDVPFQLKPASDTEGDQNKKKYFLHTSTPLDYEATREFNVVIVAVDSGSPSLSSNNSLIVKVGDTNDNPPMFGQSVVEVYFPENNIPGERVATVLATDADSGKNAEIAYSLDSSVMGIFAIDPDSGDILVNTVLDREQTDRYEFKVNAKDKGIPVLQGSTTVIVQVADKNDNDPKFMQDVFTFYVKENLQPNSPVGMVTVMDADKGRNAEMSLYIEENNNIFSIENDTGTIYSTMSFDREHQTTYTFRVKAVDGGDPPRSATATVSLFVMDENDNAPTVTLPKNISYTLLPPSSNVRTVVATVLATDSDDGINADLNYSIVGGNPFKLFEIDPTSGVVSLVGKLTQKHYGLHRLVVQVNDSGQPSQSTTTLVHVFVNESVSNATAIDSQIARSLHIPLTQDIAGDPSYEISKQRLSIVIGVVAGIMTVILIILIVVMARYCRSKNKNGYEAGKKDHEDFFTPQQHDKSKKPKKDKKNKKSKQPLYSSIVTVEASKPNGQRYDSVNEKLSDSPSMGRYRSVNGGPGSPDLARHYKSSSPLPTVQLHPQSPTAGKKHQAVQDLPPANTFVGAGDNISIGSDHCSEYSCQTNNKYSKQPFRRVTFSVVSQPQDPHQGSLQSCYDSGLEESETPSSKSSSGPRLGALPLPEDNYERTTPDGSVGEAEHMENDSRPLPDVALTGKCTRECDEYGHSDSCWMPVRTSPERKKSQPKLSTFMPVDERGSQEKLANGEAAIMGDRNRNLLNKKLTSSYETFSAASFSKNEEANPEDIPLTKTGEYKPSPVNTLTRREVYL

SEQ ID NO: 15 - protein, 232 aa, Homo sapiens
MERCPSLGVTLYALVVVLGLRATPAGGQHYLHIRPAPSDNLPLVDLIEHPDPIFDPKEKDLNETLLRSLLGGHYDPGFMATSPPEDRPGGGGGAAGGAEDLAELDQLLRQRPSGAMPSEIKGLEFSEGLAQGKKQRLSKKLRRKLQMWLWSQTFCPVLYAWNDLGSRFWPRYVKVGSCFSKRSCSVPEGMVCKPSKSVHLTVLRWRCQRRGGQRCGWIPIQYPIISECKCSC

SEQ ID NO: 16 - protein, 871 aa, Homo sapiens
MKYSCCALVLAVLGTELLGSLCSTVRSPRFRGRIQQERKNIRPNIILVLTDDQDVELGSLQVMNKTRKIMEHGGATFINAFVTTPMCCPSRSSMLTGKYVHNHNVYTNNENCSSPSWQAMHEPRTFAVYLNNTGYRTAFFGKYLNEYNGSYIPPGWREWLGLIKNSRFYNYTVCRNGIKEKHGFDYAKDYFTDLITNESINYFKMSKRMYPHRPVMMVISHAAPHGPEDSAPQFSKLYPNASQHITPSYNYAPNMDKHWIMQYTGPMLPIHMEFTNILQRKRLQTLMSVDDSVERLYNMLVETGELENTYIIYTADHGYHIGQFGLVKGKSMPYDFDIRVPFFIRGPSVEPGSIVPQIVLNIDLAPTILDIAGLDTPPDVDGKSVLKLLDPEKPGNRFRTNKKAKIWRDTFLVERGKFLRKKEESSKNIQQSNHLPKYERVKELCQQARYQTACEQPGQKWQCIEDTSGKLRIHKCKGPSDLLTVRQSTRNLYARGFHDKDKECSCRESGYRASRSQRKSQRQFLRNQGTPKYKPRFVHTRQTRSLSVEFEGEIYDINLEEEEELQVLQPRNIAKRHDEGHKGPRDLQASSGGNRGRMLADSSNAVGPPTTVRVTHKCFILPNDSIHCERELYQSARAWKDHKAYIDKEIEALQDKIKNLREVRGHLKRRKPEECSCSKQSYYNKEKGVKKQEKLKSHLHPFKEAAQEVDSKLQLFKENNRRRKKERKEKRRQRKGEECSLPGLTCFTHDNNHWQTAPFWNLGSFCACTSSNNNTYWCLRTVNETHNFLFCEFATGFLEYFDMNTDPYQLTNTVHTVERGILNQLHVQLMELRSCQGYKQCNPRPKNLDVGNKDGGSYDLHRGQLWDGWEG

SEQ ID NO: 17 - protein, 831 aa, Homo sapiens
MERPWGAADGLSRWPHGLGLLLLLQLLPPSTLSQDRLDAPPPPAAPLPRWSGPIGVSWGLRAAAAGGAFPRGGRWRRSAPGEDEECGRVRDFVAKLANNTHQHVFDDLRGSVSLSWVGDSTGVILVLTTFHVPLVIMTFGQSKLYRSEDYGKNFKDITDLINNTFIRTEFGMAIGPENSGKVVLTAEVSGGSRGGRIFRSSDFAKNFVQTDLPFHPLTQMMYSPQNSDYLLALSTENGLWVSKNFGGKWEEIHKAVCLAKWGSDNTIFFTTYANGSCKADLGALELWRTSDLGKSFKTIGVKIYSFGLGGRFLFASVMADKDTTRRIHVSTDQGDTWSMAQLPSVGQEQFYSILAANDDMVFMHVDEPGDTGFGTIFTSDDRGIVYSKSLDRHLYTTTGGETDFTNVTSLRGVYITSVLSEDNSIQTMITFDQGGRWTHLRKPENSECDATAKNKNECSLHIHASYSISQKLNVPMAPLSEPNAVGIVIAHGSVGDAISVMVPDVYISDDGGYSWTKMLEGPHYYTILDSGGIIVAIEHSSRPINVIKFSTDEGQCWQTYTFTRDPIYFTGLASEPGARSMNISIWGFTESFLTSQWVSYTIDFKDILERNCEEKDYTIWLAHSTDPEDYEDGCILGYKEQFLRLRKSSVCQNGRDYVVTKQPSICLCSLEDFLCDFGYYRPENDSKCVEQPELKGHDLEFCLYGREEHLTTNGYRKIPGDKCQGGVNPVREVKDLKKKCTSNFLSPEKQNSKSNSVPIILAIVGLMLVTVVAGVLIVKKYVCGGRFLVHRYSVLQQHAEANGVDGVDALDTASHTNKSGYHDDSDEDLLE

SEQ ID NO: 18 - protein, 694 aa, Homo sapiens
MTFGQSKLYRSEDYGKNFKDITDLINNTFIRTEFGMAIGPENSGKVVLTAEVSGGSRGGRIFRSSDFAKNFVQTDLPFHPLTQMMYSPQNSDYLLALSTENGLWVSKNFGGKWEEIHKAVCLAKWGSDNTIFFTTYANGSCTDLGALELWRTSDLGKSFKTIGVKIYSFGLGGRFLFASVMADKDTTRRIHVSTDQGDTWSMAQLPSVGQEQFYSILAANDDMVFMHVDEPGDTGFGTIFTSDDRGIVYSKSLDRHLYTTTGGETDFTNVTSLRGVYITSVLSEDNSIQTMITFDQGGRWTHLRKPENSECDATAKNKNECSLHIHASYSISQKLNVPMAPLSEPNAVGIVIAHGSVGDAISVMVPDVYISDDGGYSWTKMLEGPHYYTILDSGGIIVAIEHSSRPINVIKFSTDEGQCWQTYTFTRDPIYFTGLASEPGARSMNISIWGFTESFLTSQWVSYTIDFKDILERNCEEKDYTIWLAHSTDPEDYEDGCILGYKEQFLRLRKSSVCQNGRDYVVTKQPSICLCSLEDFLCDFGYYRPENDSKCVEQPELKGHDLEFCLYGREEHLTTNGYRKIPGDKCQGGVNPVREVKDLKKKCTSNFLSPEKQNSKSNSVPIILAIVGLMLVTVVAGVLIVKKYVCGGRFLVHRYSVLQQHAEANGVDGVDALDTASHTNKSGYHDDSDEDLLE

SEQ ID NO: 19 - protein, 303 aa, Homo sapiens
MARGKAKEEGSWKKFIWNSEKKEFLGRTGGSWFKILLFYVIFYGCLAGIFIGTIQVMLLTISEFKPTYQDRVAPPGLTQIPQIQKTEISFRPNDPKSYEAYVLNIVRFLEKYKDSAQRDDMIFEDCGDVPSEPKERGDFNHERGERKVCRFKLEWLGNCSGLNDETYGYKEGKPCIIIKLNRVLGFKPKPPKNESLETYPVMKYNPNVLPVQCTGKRDEDKDKVGNVEYFGLGNSPGFPLQYYPYYGKLLQPKYLQPLLAVQFTNLTMDTEIRIECKAYGENIGYSEKDRFQGRFDVKIEVKS

SEQ ID NO: 20 - protein, 2045 aa, Homo sapiens
MAGRSHPGPLRPLLPLLVVAACVLPGAGGTCPERALERREEEANVVLTGTVEEILNVDPVQHTYSCKVRVWRYLKGKDLVARESLLDGGNKVVISGFGDPLICDNQVSTGDTRIFFVNPAPPYLWPAHKNELMLNSSLMRITLRNLEEVEFCVEDKPGTHFTPVPPTPPDACRGMLCGFGAVCEPNAEGPGRASCVCKKSPCPSVVAPVCGSDASTYSNECELQRAQCSQQRRIRLLSRGPCGSRDPCSNVTCSFGSTCARSADGLTASCLCPATCRGAPEGTVCGSDGADYPGECQLLRRACARQENVFKKFDGPCDPCQGALPDPSRSCRVNPRTRRPEMLLRPESCPARQAPVCGDDGVTYENDCVMGRSGAARGLLLQKVRSGQCQGRDQCPEPCRFNAVCLSRRGRPRCSCDRVTCDGAYRPVCAQDGRTYDSDCWRQQAECRQQRAIPSKHQGPCDQAPSPCLGVQCAFGATCAVKNGQAACECLQACSSLYDPVCGSDGVTYGSACELEATACTLGREIQVARKGPCDRCGQCRFGALCEAETGRCVCPSECVALAQPVCGSDGHTYPSECMLHVHACTHQISLHVASAGPCETCGDAVCAFGAVCSAGQCVCPRCEHPPPGPVCGSDGVTYGSACELREAACLQQTQIEEARAGPCEQAECGSGGSGSGEDGDCEQELCRQRGGIWDEDSEDGPCVCDFSCQSVPGSPVCGSDGVTYSTECELKKARCESQRGLYVAAQGACRGPTFAPLPPVAPLHCAQTPYGCCQDNITAARGVGLAGCPSACQCNPHGSYGGTCDPATGQCSCRPGVGGLRCDRCEPGFWNFRGIVTDGRSGCTPCSCDPQGAVRDDCEQMTGLCSCKPGVAGPKCGQCPDGRALGPAGCEADASAPATCAEMRCEFGARCVEESGSAHCVCPMLTCPEANATKVCGSDGVTYGNECQLKTIACRQGLQISIQSLGPCQEAVAPSTHPTSASVTVTTPGLLLSQALPAPPGALPLAPSSTAHSQTTPPPSSRPRTTASVPRTTVWPVLTVPPTAPSPAPSLVASAFGESGSTDGSSDEELSGDQEASGGGSGGLEPLEGSSVATPGPPVERASCYNSALGCCSDGKTPSLDAEGSNCPATKVFQGVLELEGVEGQELFYTPEMADPKSELFGETARSIESTLDDLFRNSDVKKDFRSVRLRDLGPGKSVRAIVDVHFDPTTAFRAPDVARALLRQIQVSRRRSLGVRRPLQEHVRFMDFDWFPAFITGATSGAIAAGATARATTASRLPSSAVTPRAPHPSHTSQPVAKTTAAPTTRRPPTTAPSRVPGRRPPAPQQPPKPCDSQPCFHGGTCQDWALGGGFTCSCPAGRGGAVCEKVLGAPVPAFEGRSFLAFPTLRAYHTLRLALEFRALEPQGLLLYNGNARGKDFLALALLDGRVQLRFDTGSGPAVLTSAVPVEPGQWHRLELSRHWRRGTLSVDGETPVLGESPSGTDGLNLDTDLFVGGVPEDQAAVALERTFVGAGLRGCIRLLDVNNQRLELGIGPGAATRGSGVGECGDHPCLPNPCHGGAPCQNLEAGRFHCQCPPGRVGPTCADEKSPCQPNPCHGAAPCRVLPEGGAQCECPLGREGTFCQTASGQDGSGPFLADFNGFSHLELRGLHTFARDLGEKMALEVVFLARGPSGLLLYNGQKTDGKGDFVSLALRDRRLEFRYDLGKGAAVIRSREPVTLGAWTRVSLERNGRKGALRVGDGPRVLGESPVPHTVLNLKEPLYVGGAPDFSKLARAAAVSSGFDGAIQLVSLGGRQLLTPEHVLRQVDVTSFAGHPCTRASGHPCLNGASCVPREAAYVCLCPGGFSGPHCEKGLVEKSAGDVDTLAFDGRTFVEYLNAVTESEKALQSNHFELSLRTEATQGLVLWSGKATERADYVALAIVDGHLQLSYNLGSQPVVLRSTVPVNTNRWLRVVAHREQREGSLQVGNEAPVTGSSPLGATQLDTDGALWLGGLPELPVGPALPKAYGTGFVGCLRDVVVGRHPLHLLEDAVTKPELRPCPTP

SEQ ID NO: 21 - protein, 770 aa, Homo sapiens
MLPGLALLLLAAWTARALEVPTDGNAGLLAEPQIAMFCGRLNMHMNVQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAMSQSLLKTTQEPLARDPVKLPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 22 - protein, 751 aa, Homo sapiens
MLPGLALLLLAAWTARALEVPTDGNAGLLAEPQIAMFCGRLNMHMNVQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAIPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 23 - protein, 714 aa, Homo sapiens
MLPGLALLLLAAWTARALEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAMSQSLLKTTQEPLARDPVKLPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 24 - protein, 695 aa, Homo sapiens
MLPGLALLLLAAWTARALEVPTDGNAGLLAEPQIAMFCGRLNMHMNVQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVRVPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 25 - protein, 639 aa, Homo sapiens
MLPGLALLLLAAWTARALEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVRVPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 26 - protein, 742 aa, Homo sapiens
MKDDFAEEEEVQSFGYKRFGIQEGTQCTKCKNNWALKFSIILLYILCALLTITVAILGYKVVEKMDNVTGGMETSRQTYDDKLTAVESDLKKLGDQTGKKAISTNSELSTFRSDILDLRQQLREITEKTSKNKDTLEKLQASGDALVDRQSQLKETLENNSFLITTVNKTLQAYNGYVTNLQQDTSVLQGNLQNQMYSHNVVIMNLNNLNLTQVQQRNLITNLQRSVDDTSQAIQRIKNDFQNLQQVFLQAKKDTDWLKEKVQSLQTLAANNSALAKANNDTLEDMNSQLNSFTGQMENITTISQANEQNLKDLQDLHKDAENRTAIKFNQLEERFQLFETDIVNIISNISYTAHHLRTLTSNLNEVRTTCTDTLTKHTDDLTSLNNTLANIRLDSVSLRMQQDLMRSRLDTEVANLSVIMEEMKLVDSKHGQLIKNFTILQGPPGPRGPRGDRGSQGPPGPTGNKGQKGEKGEPGPPGPAGERGPIGPAGPPGERGGKGSKGSQGPKGSRGSPGKPGPQGPSGDPGPPGPPGKEGLPGPQGPPGFQGLQGTVGEPGVPGPRGLPGLPGVPGMPGPKGPPGPPGPSGAVVPLALQNEPTPAPEDNGCPPHWKNFTDKCYYFSVEKEIFEDAKLFCEDKSSHLVFINTREEQQWIKKQMVGRESHWIGLTDSERENEWKWLDGTSPDYKNWKAGQPDNWGHGHGPGEDCAGLIYAGQWNDFQCEDVNNFICEKDRETVLSSAL

SEQ ID NO: 27 - protein, 848 aa, Homo sapiens
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKTLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVQGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPANGSPTSGLSTGAIVGILIVIFVLLLVVVDITCYFLNKCGLFMCIAVNLCGKAGPGAKGKDMEEGKAAFSKDESKEPIVEVRTEEERTPNHDGGKHTEPNETTPLTEPEKGPVEAKPECQETETKPAPAEVKTVPNDATQTKENESKA

SEQ ID NO: 28 - protein, 761 aa, Homo sapiens
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKTLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVHSPPPPASASSSTPVPLSPPDTTWPLPALATTEPAKGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPATLGGNSASYTFVSLLFSAVTLLLLC

SEQ ID NO: 29 - protein, 858 aa, Homo sapiens
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKASWTRPEKQETLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVQGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPANGSPTSGLSTGAIVGILIVIFVLLLVVVDITCYFLNKCGLFMCIAVNLCGKAGPGAKGKDMEEGKAAFSKDESKEPIVEVRTEEERTPNHDGGKHTEPNETTPLTEPEKGPVEAKPECQETETKPAPAEVKTVPNDATQTKENESKA

SEQ ID NO: 30 - protein, 726 aa, Homo sapiens
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKTLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVQGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPATLGGNSASYTFVSLLFSAVTLLLLC

SEQ ID NO: 31 - protein, 884 aa, Homo sapiens
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKASWTRPEKQEVHAPWNWQVGRQKGQAGSAGFPGSHETLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVQGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPANGSPTSGLSTGAIVGILIVIFVLLLVVVDITCYFLNKCGLFMCIAVNLCGKAGPGAKGKDMEEGKAAFSKDESKEPIVEVRTEEERTPNHDGGKHTEPNETTPLTEPEKGPVEAKPECQETETKPAPAEVKTVPNDATQTKENESKA

SEQ ID NO: 32 - protein, 931 aa, Homo sapiens
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIKFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKLFEGNMHYDTPDIRRFDPIPAQYVRVYPERWSPAGIGMRLEVLGCDWTDSKPTVETLGPTVKSEETTTPYPTEEEATECGENCSFEDDKDLQLPSGFNCNFDFLEEPCGWMYDHAKWLRTTWASSSSPNDRTFPDDRNFLRLQSDSQREGQYARLISPPVHLPRSPVCMEFQYQATGGRGVALQVVREASQESKLLWVIREDQGGEWKHGRIILPSYDMEYQIVFEGVIGKGRSGEIAIDDIRISTDVPLENCMEPISAFAGENFKVDIPEIHEREGYEDEIDDEYEVDWSNSSSATSGSGAPSTDKEKSWLYTLDPILITIIAMSSLGVLLGATCAGLLLYCTCSYSGLSSRSCTTLENYNFELYDGLKHKVKMNHQKCCSEA

SEQ ID NO: 33 - protein, 926 aa, Homo sapiens
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIKFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKLFEGNMHYDTPDIRRFDPIPAQYVRVYPERWSPAGIGMRLEVLGCDWTDSKPTVETLGPTVKSEETTTPYPTEEEATECGENCSFEDDKDLQLPSGFNCNFDFLEEPCGWMYDHAKWLRTTWASSSSPNDRTFPDDRNFLRLQSDSQREGQYARLISPPVHLPRSPVCMEFQYQATGGRGVALQVVREASQESKLLWVIREDQGGEWKHGRIILPSYDMEYQIVFEGVIGKGRSGEIAIDDIRISTDVPLENCMEPISAFAVDIPEIHEREGYEDEIDDEYEVDWSNSSSATSGSGAPSTDKEKSWLYTLDPILITIIAMSSLGVLLGATCAGLLLYCTCSYSGLSSRSCTTLENYNFELYDGLKHKVKMNHQKCCSEA

SEQ ID NO: 34 - protein, 909 aa, Homo sapiens
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIKFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKLFEGNMHYDTPDIRRFDPIPAQYVRVYPERWSPAGIGMRLEVLGCDWTDSKPTVETLGPTVKSEETTTPYPTEEEATECGENCSFEDDKDLQLPSGFNCNFDFLEEPCGWMYDHAKWLRTTWASSSSPNDRTFPDDRNFLRLQSDSQREGQYARLISPPVHLPRSPVCMEFQYQATGGRGVALQVVREASQESKLLWVIREDQGGEWKHGRIILPSYDMEYQIVFEGVIGKGRSGEIAIDDIRISTDVPLENCMEPISAFADEYEVDWSNSSSATSGSGAPSTDKEKSWLYTLDPILITIIAMSSLGVLLGATCAGLLLYCTCSYSGLSSRSCTTLENYNFELYDGLKHKVKMNHQKCCSEA

SEQ ID NO: 35 - protein, 906 aa, Homo sapiens
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIKFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKLFEGNMHYDTPDIRRFDPIPAQYVRVYPERWSPAGIGMRLEVLGCDWTDSKPTVETLGPTVKSEETTTPYPTEEEATECGENCSFEDDKDLQLPSGFNCNFDFLEEPCGWMYDHAKWLRTTWASSSSPNDRTFPDDRNFLRLQSDSQREGQYARLISPPVHLPRSPVCMEFQYQATGGRGVALQVVREASQESKLLWVIREDQGGEWKHGRIILPSYDMEYQIVFEGVIGKGRSGEIAIDDIRISTDVPLENCMEPISAFAGENFKGGTLLPGTEPTVDTVPMQPIPAYWYYVMAAGGAVLVLVSVALALVLHYHRFRYAAKKTDHSITYKTSHYTNGAPLAVEPTLTIKLEQDRGSHC

SEQ ID NO: 36 - protein, 901 aa, Homo sapiens
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIKFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKLFEGNMHYDTPDIRRFDPIPAQYVRVYPERWSPAGIGMRLEVLGCDWTDSKPTVETLGPTVKSEETTTPYPTEEEATECGENCSFEDDKDLQLPSGFNCNFDFLEEPCGWMYDHAKWLRTTWASSSSPNDRTFPDDRNFLRLQSDSQREGQYARLISPPVHLPRSPVCMEFQYQATGGRGVALQVVREASQESKLLWVIREDQGGEWKHGRIILPSYDMEYQIVFEGVIGKGRSGEIAIDDIRISTDVPLENCMEPISAFAGGTLLPGTEPTVDTVPMQPIPAYWYYVMAAGGAVLVLVSVALALVLHYHRFRYAAKKTDHSITYKTSHYTNGAPLAVEPTLTIKLEQDRGSHC

SEQ ID NO: 37 - protein, 555 aa, Homo sapiens
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIKFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKVGCSWRPL

SEQ ID NO: 38 - protein, 1894 aa, Homo sapiens
MEQRRPWPRALEVDSRSVVLLSVVWVLLAPPAAGMPQFSTFHSENRDWTFNHLTVHQGTGAVYVGAINRVYKLTGNLTIQVAHKTGPEEDNKSCYPPLIVQPCSEVLTLTNNVNKLLIIDYSENRLLACGSLYQGVCKLLRLDDLFILVEPSHKKEHYLSSVNKTGTMYGVIVRSEGEDGKLFIGTAVDGKQDYFPTLSSRKLPRDPESSAMLDYELHSDFVSSLIKIPSDTLALVSHFDIFYIYGFASGGFVYFLTVQPETPEGVAINSAGDLFYTSRIVRLCKDDPKFHSYVSLPFGCTRAGVEYRLLQAAYLAKPGDSLAQAFNITSQDDVLFAIFSKGQKQYHHPPDDSALCAFPIRAINLQIKERLQSCYQGEGNLELNWLLGKDVQCTKAPVPIDDNFCGLDINQPLGGSTPVEGLTLYTTSRDRMTSVASYVYNGYSVVFVGTKSGKLKKIRADGPPHGGVQYEMVSVLKDGSPILRDMAFSIDQRYLYVMSERQVTRVPVESCEQYTTCGECLSSGDPHCGWCALHNMCSRRDKCQQAWEPNRFAASISQCVSLAVHPSSISVSEHSRLLSLVVSDAPDLSAGIACAFGNLTEVEGQVSGSQVICISPGPKDVPVIPLDQDWFGLELQLRSKETGKIFVSTEFKFYNCSAHQLCLSCVNSAFRCHWCKYRNLCTHDPTTCSFQEGRINISEDCPQLVPTEEILIPVGEVKPITLKARNLPQPQSGQRGYECVLNIQGAIHRVPALRFNSSSVQCQNSSYQYDGMDISNLAVDFAVVWNGNFIIDNPQDLKVHLYKCAAQRESCGLCLKADRKFECGWCSGERRCTLHQHCTSPSSPWLDWSSHNVKCSNPQITEILTVSGPPEGGTRVTIHGVNLGLDFSEIAHHVQVAGVPCTPLPGEYIIAEQIVCEMGHALVGTTSGPVRLCIGECKPEFMTKSHQQYTFVNPSVLSLNPIRGPESGGTMVTITGHYLGAGSSVAVYLGNQTCEFYGRSMSEIVCVSPPSSNGLGPVPVSVSVDRAHVDSNLQFEYIDDPRVQRIEPEWSIASGHTPLTITGFNLDVIQEPRIRVKFNGKESVNVCKVVNTTTLTCLAPSLTTDYRPGLDTVERPDEFGFVFNNVQSLLIYNDTKFIYYPNPTFELLSPTGVLDQKPGSPIILKGKNLCPPASGGAKLNYTVLIGETPCAVTVSETQLLCEPPNLTGQHKVMVHVGGMVFSPGSVSVISDSLLTLPAIVSIAAGGSLLLIIVIIVLIAYKRKSRENDLTLKRLQMQMDNLESRVALECKEAFAELQTDINELTSDLDRSGIPYLDYRTYAMRVLFPGIEDHPVLRELEVQGNGQQHVEKALKLFAQLINNKVFLLTFIRTLELQRSFSMRDRGNVASLIMTGLQGRLEYATDVLKQLLSDLIDKNLENKNHPKLLLRRTESVAEKMLTNWFAFLLHKFLKECAGEPLFMLYCAIKQQMEKGPIDAITGEARYSLSEDKLIRQQIEYKTLILNCVNPDNENSPEIPVKVLNCDTITQVKEKILDAVYKNVPYSQRPRAVDMDLEWRQGRIARVVLQDEDITTKIEGDWKRLNTLMHYQVSDRSVVALVPKQTSSYNIPASASISRTSISRYDSSFRYTGSPDSLRSRAPMITPDLESGVKVWHLVKNHDHGDQKEGDRGSKMVSEIYLTRLLATKGTLQKFVDDLFETLFSTVHRGSALPLAIKYMFDFLDEQADRHSIHDTDVRHTWKSNCLPLRFWVNVIKNPQFVFDIHKGSITDACLSVVAQTFMDSCSTSEHRLGKDSPSNKLLYAKDIPSYKSWVERYYADIAKLPAISDQDMNAYLAEQSRLHAVEFNMLSALNEIYSYVSKYSEELIGALEQDEQARRQRLAYKVEQLINAMSIES

SEQ ID NO: 39 - protein, 947 aa, Homo sapiens
MEFSWGSGQESRRLLLLLLLLAAWEAGNGQLHYSVSEEAKHGTFVGRIAQDLGLELAELVPRLFRVASKGRGGLLEVNLQNGILFVNSRIDREELCRRSAECSIHLEVIVDRPLQVFHVDVEVRDINDNPPVFPATQKNLSIAESRPLDSRFPLEGASDADIGENALLTYRLSPNEYFSLEKPPDDELVKGLGLILRKSLDREEAPEIFLVLTATDGGKPELTGTVQLLITVLDANDNAPAFDRTIYKVRLLENVPNGTLVIKLNASDLDEGLNGDIVYSFSNDISPNVKSKFHIDPITGQIIVKGYIDFEESKSYEIIVEGIDKGQLPLSGHCRVIVEVEDNNDNVPDLEFKSLSLPIREDAPLGTVIALISVSDKDMGVNGLVTCSLTSHVPFKLVSTFKNYYSLVLDSALDRESVSAYELVVTARDGGSPSLWATASVSVEVADVNDNAPAFAQPEYTVFVKENNPPGCHIFTVSAWDADAQENALVSYSLVERRVGERALSSYVSVHAESGKVYALQPLDHEELELLQFQVTARDAGVPPLGSNVTLQVFVLDENDNAPALLAPRAGGTGGAVSELVPWSVGVGHVVAKVRAVDADSGYNAWLSYELQPGTGGARIPFRVGLYTGEISTTRALDETDAPRHRLLVLVKDHGEPALTATATVLVSLVESGQAPKASSRALVGAVGPDAALVDVNVYLIIAICAVSSLLVLTLLLYTALRCSALPTEGACAPGKPTLVCSSAVGSWSYSQQRRPRVCSGEGPPKTDLMAFSPSLPDSRDREDQLQTTEESFAKPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 40 - protein, 798 aa, Homo sapiens
MEFSWGSGQESRRLLLLLLLLAAWEAGNGQLHYSVSEEAKHGTFVGRIAQDLGLELAELVPRLFRVASKGRGGLLEVNLQNGILFVNSRIDREELCRRSAECSIHLEVIVDRPLQVFHVDVEVRDINDNPPVFPATQKNLSIAESRPLDSRFPLEGASDADIGENALLTYRLSPNEYFSLEKPPDDELVKGLGLILRKSLDREEAPEIFLVLTATDGGKPELTGTVQLLITVLDANDNAPAFDRTIYKVRLLENVPNGTLVIKLNASDLDEGLNGDIVYSFSNDISPNVKSKFHIDPITGQIIVKGYIDFEESKSYEIIVEGIDKGQLPLSGHCRVIVEVEDNNDNVPDLEFKSLSLPIREDAPLGTVIALISVSDKDMGVNGLVTCSLTSHVPFKLVSTFKNYYSLVLDSALDRESVSAYELVVTARDGGSPSLWATASVSVEVADVNDNAPAFAQPEYTVFVKENNPPGCHIFTVSAWDADAQENALVSYSLVERRVGERALSSYVSVHAESGKVYALQPLDHEELELLQFQVTARDAGVPPLGSNVTLQVFVLDENDNAPALLAPRAGGTGGAVSELVPWSVGVGHVVAKVRAVDADSGYNAWLSYELQPGTGGARIPFRVGLYTGEISTTRALDETDAPRHRLLVLVKDHGEPALTATATVLVSLVESGQAPKASSRALVGAVGPDAALVDVNVYLIIAICAVSSLLVLTLLLYTALRCSALPTEGACAPGKPTLVCSSAVGSWSYSQQRRPRVCSGEGPPKTDLMAFSPSLPDSRDREDQLQTTEESFAKVSV

SEQ ID NO: 41 - protein, 1007 aa, Homo sapiens
MEQAGTRPAATEHPRLRRPMPWLLLLPLLLLLLLLLPGPAASQLRYSVPEEQAPGALVGNVARALGLELRRLGPGCLRINHLGAPSPRYLELDLTSGALFVNERIDREALCEQRPRCLLSLEVLAHNPVAVSAVEVEILDINDNSPRFPRPNYQLQVSESVAPGARFHIESAQDPDVGANSVQTYELSPSEHFELDLKPLQENSKVLELVLRKGLDREQAALHHLVLTAVDGGIPARSGTAQISVRVLDTNDNSPAFDQSTYRVQLREDSPPGTLVVKLNASDPDEGSNGELRYSLSSYTSDRERQLFSIDASTGEVRVIGGLDYEEASSYQIYVQATDRGPVPMAGHCKVLVDIVDVNDNAPEVVLTDLYSPVPENATPNTIVAVLSVNDQDSGPNRKVSLGLEATLPFRLNGFGNSYTLVVSGPLDRERVAVYNITVTATDGGIPQLTSLRTLKVEISDINDNPPSFLEDSYSIYIQENNLPGVLLCTVQATDPDEKENAEVTYSLLEREIQGLPVTSYVSINSASGSLYAVNSFDYEKFREFFVTVEAQDKGSPPLSSTVTANVYVVDMNDHAPHILYPTSTNSSAAFEMVPRTAPAGYLVTKVIAMDSDSGQNAWLFYHLAQTSDLDLFKVELHTGEIRTTRKMGDESGSTFNLTVVVRDNGEPSLSASVAITVAVVDRVSKILPDTQRHVKSPRTYSEITLYLIIALSTVSFIFLLTIIILSIIKCYRYTAYGTACCGGFCGVRERSPAELYKQANNNIDARIPHGLKVQPHFIEVRGNGSLTKTYCYKACLTAGSGSDTFMFYNTGAQTGPGPSGAQAAVTDSRNLTGQSGQNAGNLIILKNEAVSQNEPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 42 - protein, 884 aa, Homo sapiens
MEQAGTRPAATEHPRLRRPMPWLLLLPLLLLLLLLLPGPAASQLRYSVPEEQAPGALVGNVARALGLELRRLGPGCLRINHLGAPSPRYLELDLTSGALFVNERIDREALCEQRPRCLLSLEVLAHNPVAVSAVEVEILDINDNSPRFPRPNYQLQVSESVAPGARFHIESAQDPDVGANSVQTYELSPSEHFELDLKPLQENSKVLELVLRKGLDREQAALHHLVLTAVDGGIPARSGTAQISVRVLDTNDNSPAFDQSTYRVQLREDSPPGTLVVKLNASDPDEGSNGELRYSLSSYTSDRERQLFSIDASTGEVRVIGGLDYEEASSYQIYVQATDRGPVPMAGHCKVLVDIVDVNDNAPEVVLTDLYSPVPENATPNTIVAVLSVNDQDSGPNRKVSLGLEATLPFRLNGFGNSYTLVVSGPLDRERVAVYNITVTATDGGIPQLTSLRTLKVEISDINDNPPSFLEDSYSIYIQENNLPGVLLCTVQATDPDEKENAEVTYSLLEREIQGLPVTSYVSINSASGSLYAVNSFDYEKFREFFVTVEAQDKGSPPLSSTVTANVYVVDMNDHAPHILYPTSTNSSAAFEMVPRTAPAGYLVTKVIAMDSDSGQNAWLFYHLAQTSDLDLFKVELHTGEIRTTRKMGDESGSTFNLTVVVRDNGEPSLSASVAITVAVVDRVSKILPDTQRHVKSPRTYSEITLYLIIALSTVSFIFLLTIIILSIIKCYRYTAYGTACCGGFCGVRERSPAELYKQANNNIDARIPHGLKVQPHFIEVRGNGSLTKTYCYKACLTAGSGSDTFMFYNTGAQTGPGPSGAQAAVTDSRNLTGQSGQNAGNLIILKNEAVSQNEVRQWSGGLLQTHAFVTHPPISCDLALLSH

SEQ ID NO: 43 - protein, 1028 aa, Homo sapiens
MRLLWKLVILLPLINSSAGDGLLSRPIFTQEPHDVIFPLDLSKSEVILNCAANGYPSPHYRWKQNGTDIDFTMSYHYRLDGGSLAINSPHTDQDIGMYQCLATNLLGTILSRKAKLQFAYIEDFETKTRSTVSVREGQGVVLLCGPPPHFGDLSYAWTFNDNPLYVQEDNRRFVSQETGNLYIAKVEPSDVGNYTCFITNKEAQRSVQGPPTPLVQRTDGVMGEYEPKIEVRFPETIQAAKDSSVKLECFALGNPVPDISWRRLDGSPLPGKVKYSKSQAILEIPNFQQEDEGFYECIASNLRGRNLAKGQLIFYAPPEWEQKIQNTHLSIYDNLLWECKASGKPNPWYTWLKNGERLNPEERIQIENGTLIITMLNVSDSGVYQCAAENKYQIIYANAELRVLASAPDFSKSPVKKKSFVQVGGDIVIGCKPNAFPRAAISWKRGTETLRQSKRIFLLEDGSLKIYNITRSDAGSYTCIATNQFGTAKNTGSLIVKERTVITVPPSKMDVTVGESIVLPCQVSHDPSIEVVFVWFFNGDVIDLKKGVAHFERIGGESVGDLMIRNIQLHHSGKYLCTVQTTLESLSAVADIIVRGPPGPPEDVQVEDISSTTSQLSWRAGPDNNSPIQIFTIQTRTPFSVGWQAVATVPEILNGKTYNATVVGLSPWVEYEFRVVAGNSIGIGEPSEPSELLRTKASVPVVAPVNIHGGGGSRSELVITWESIPEELQNGEGFGYIIMFRPVGSTTWSKEKVSSVESSRFVYRNESIIPLSPFEVKVGVYNNEGEGSLSTVTIVYSGEDEPQLAPRGTSLQSFSASEMEVSWNAIAWNRNTGRVLGYEVLYWTDDSKESMIGKIRVSGNVTTKNITGLKANTIYFASVRAYNTAGTGPSSPPVNVTTKKSPPSQPPANIAWKLTNSKLCLNWEHVKTMENESEVLGYKILYRQNRQSKTHILETNNTSAELLVPFEEDYLIEIRTVSDGGDGSSSEEIRIPKMSSLSSRGIQFLEPSTHFLSIVIVIFHCFAIQPLI

SEQ ID NO: 44 - protein, 556 aa, Homo sapiens
MARFGLPALLCTLAVLSAALLAAELKSKSCSEVRRLYVSKGFNKNDAPLHEINGDHLKICPQGSTCCSQEMEEKYSLQSKDDFKSVVSEQCNHLQAVFASRYKKFDEFFKELLENAEKSLNDMFVKTYGHLYMQNSELFKDLFVELKRYYVVGNVNLEEMLNDFWARLLERMFRLVNSQYHFTDEYLECVSKYTEQLKPFGDVPRKLKLQVTRAFVAARTFAQGLAVAGDVVSKVSVVNPTAQCTHALLKMIYCSHCRGLVTVKPCYNYCSNIMRGCLANQGDLDFEWNNFIDAMLMVAERLEGPFNIESVMDPIDVKISDAIMNMQDNSVQVSQKVFQGCGPPKPLPAGRISRSISESAFSARFRPHHPEERPTTAAGTSLDRLVTDVKEKLKQAKKFWSSLPSNVCNDERMAAGNGNEDDCWNGKGKSRYLFAVTGNGLANQGNNPEVQVDTSKPDILILRQIMALRVMTSKMKNAYNGNDVDFFDISDESSGEGSGSGCEYQQCPSEFDYNATDHAGKSANEKADSAGVRPGAQAYLLTVFCILFLVMQREWR

SEQ ID NO: 45 - protein, 726 aa, Homo sapiens
MEPGDAARPGSGRATGAPPPRLLLLPLLLGWGLRVAAAASASSSGAAAEDSSAMEELATEKEAEESHRQDSVSLLTFILLLTLTILTIWLFKHRRVRFLHETGLAMIYGLIVGVILRYGTPATSGRDKSLSCTQEDRAFSTLLVNVSGKFFEYTLKGEISPGKINSVEQNDMLRKVTFDPEVFFNILLPPIIFHAGYSLKKRHFFRNLGSILAYAFLGTAVSCFIIGNLMYGVVKLMKIMGQLSDKFYYTDCLFFGAIISATDPVTVLAIFNELHADVDLYALLFGESVLNDAVAIVLSSSIVAYQPAGLNTHAFDAAAFFKSVGIFLGIFSGSFTMGAVTGVVTALVTKFTKLHCFPLLETALFFLMSWSTFLLAEACGFTGVVAVLFCGITQAHYTYNNLSVESRSRTKQLFEVLHFLAENFIFSYMGLALFTFQKHVFSPIFIIGAFVAIFLGRAAHIYPLSFFLNLGRRHKIGWNFQHMMMFSGLRGAMAFALAIRDTASYARQMMFTTTLLIVFFTVWIIGGGTTPMLSWLNIRVGVEEPSEEDQNEHHWQYFRVGVDPDQDPPPNNDSFQVLQGDGPDSARGNRTKQESAWIFRLWYSFDHNYLKPILTHSGPPLTTTLPAWCGLLARCLTSPQVYDNQEPLREEDSDFILTEGDLTLTYGDSTVTANGSSSSHTASTSLEGSRRTKSSSEEVLERDLGMGDQKVSSRGTRLVFPLEDNA

SEQ ID NO: 46 - protein, 725 aa, Homo sapiens
MEPGDAARPGSGRATGAPPPRLLLLPLLLGWGLRVAAAASASSSGAAAEDSSAMEELATEKEAEESHRQDSVSLLTFILLLTLTILTIWLFKHRRVRFLHETGLAMIYGLIVGVILRYGTPATSGRDKSLSCTQEDRAFSTLLVNVSGKFFEYTLKGEISPGKINSVEQNDMLRKVTFDPEVFFNILLPPIIFHAGYSLKKRHFFRNLGSILAYAFLGTAVSCFIIGNLMYGVVKLMKIMGQLSDKFYYTDCLFFGAIISATDPVTVLAIFNELHADVDLYALLFGESVLNDAVAIVLSSSIVAYQPAGLNTHAFDAAAFFKSVGIFLGIFSGSFTMGAVTGVNANVTKFTKLHCFPLLETALFFLMSWSTFLLAEACGFTGVVAVLFCGITQAHYTYNNLSVESRSRTKQLFEVLHFLAENFIFSYMGLALFTFQKHVFSPIFIIGAFVAIFLGRAAHIYPLSFFLNLGRRHKIGWNFQHMMMFSGLRGAMAFALAIRDTASYARQMMFTTTLLIVFFTVWIIGGGTTPMLSWLNIRVGVEEPSEEDQNEHHWQYFRVGVDPDQDPPPNNDSFQVLQGDGPDSARGNRTKQESAWIFRLWYSFDHNYLKPILTHSGPPLTTTLPAWCGLLARCLTSPQVYDNQEPLREEDSDFILTEGDLTLTYGDSTVTANGSSSSHTASTSLEGSRRTKSSSEEVLERDLGMGDQKVSSRGTRLVFPLEDNA

SEQ ID NO: 47 - protein, 549 aa, Homo sapiens
MARTLRPSPLCPGGGKAQLSSASLLGAGLLLQPPTPPPLLLLLFPLLLFSRLCGALAGPIIVEPHVTAVWGKNVSLKCLIEVNETITQISWEKIHGKSSQTVAVHHPQYGFSVQGEYQGRVLFKNYSLNDATITLHNIGFSDSGKYICKAVTFPLGNAQSSTTVTVLVEPTVSLIKGPDSLIDGGNETVAAICIAATGKPVAHIDWEGDLGEMESTTTSFPNETATIISQYKLFPTRFARGRRITCVVKHPALEKDIRYSFILDIQYAPEVSVTGYDGNWFVGRKGVNLKCNADANPPPFKSVWSRLDGQWPDGLLASDNTLHFVHPLTFNYSGVYICKVTNSLGQRSDQKVIYISDPPTTTTLQPTIQWHPSTADIEDLATEPKKLPFPLSTLATIKDDTIATIIASVVGGALFIVLVSVLAGIFCYRRRRTFRGDYFAKNYIPPSDMQKESQIDVLQQDELDSYPDSVKKENKNPVNNLIRKDYLEEPEKTQWNNVENLNRFERPMDYYEDLKMGMKFVSDEHYDENEDDLVSHVDGSVISRREWYV

SEQ ID NO: 48 - protein, 366 aa, Homo sapiens
MARTLRPSPLCPGGGKAQLSSASLLGAGLLLQPPTPPPLLLLLFPLLLFSRLCGALAGPIIVEPHVTAVWGKNVSLKCLIEVNETITQISWEKIHGKSSQTVAVHHPQYGFSVQGEYQGRVLFKNYSLNDATITLHNIGFSDSGKYICKAVTFPLGNAQSSTTVTVLVEPTVSLIKGPDSLIDGGNETVAAICIAATGKPVAHIDWEGDLGEMESTTTSFPNETATIISQYKLFPTRFARGRRITCVVKHPALEKDIRYSFILDIQYAPEVSVTGYDGNWFVGRKGVNLKCNADANPPPFKSVWSRLDGQWPDGLLASDNTLHFVHPLTFNYSGVYICKVTNSLGQRSDQKVIYISAYNSVASLNC

SEQ ID NO: 49 - protein, 487 aa, Homo sapiens
MAEGWRWCFVRRTPGLLRGPLLPRSFSGNPRALAGPIIVEPHVTAVWGKNVSLKCLIEVNETITQISWEKIHGKSSQTVAVHHPQYGFSVQGEYQGRVLFKNYSLNDATITLHNIGFSDSGKYICKAVTFPLGNAQSSTTVTVLVEPTVSLIKGPDSLIDGGNETVAAICIAATGKPVAHIDWEGDLGEMESTTTSFPNETATIISQYKLFPTRFARGRRITCVVKHPALEKDIRYSFILDIQYAPEVSVTGYDGNWFVGRKGVNLKCNADANPPPFKSVWSRLDGQWPDGLLASDNTLHFVHPLTFNYSGVYICKVTNSLGQRSDQKVIYISDVPFKQTSSIAVAGAVIGAVLALFIIAIFVTVLLTPRKKRPSYLDKVIDLPPTHKPPPLYEERSPPLPQKDLFQPEHLPLQTQFKEREVGNLQHSNGLNSRSFDYEDENPVGEDGIQQMYPLYNQMCYQDRSPGKHHQNNDPKRVYIDPREHYV

SEQ ID NO: 50 - protein, 1079 aa, Homo sapiens
MEDEAVLDRGASFLKHVCDEEEVEGHHTIYIGVHVPKSYRRRRRHKRKTGHKEKKEKERISENYSDKSDIENADESSSSILKPLISPAAERIRFILGEEDDSPAPPQLFTELDELLAVDGQEMEWKETARWIKFEEKVEQGGERWSKPHVATLSLHSLFELRTCMEKGSIMLDREASSLPQLVEMIVDHQIETGLLKPELKDKVTYTLLRKHRHQTKKSNLRSLADIGKTVSSASRMFTNPDNGSPAMTHRNLTSSSLNDISDKPEKDQLKNKFMKKLPRDAEASNVLVGEVDFLDTPFIAFVRLQQAVMLGALTEVPVPTRFLFILLGPKGKAKSYHEIGRAIATLMSDEVFHDIAYKAKDRHDLIAGIDEFLDEVIVLPPGEWDPAIRIEPPKSLPSSDKRKNMYSGGENVQMNGDTPHDGGHGGGGHGDCEELQRTGRFCGGLIKDIKRKAPFFASDFYDALNIQALSAILFIYLATVTNAITFGGLLGDATDNMQGVLESFLGTAVSGAIFCLFAGQPLTILSSTGPVLVFERLLFNFSKDNNFDYLEFRLWIGLWSAFLCLILVATDASFLVQYFTRFTEEGFSSLISFIFIYDAFKKMIKLADYYPINSNFKVGYNTLFSCTCVPPDPANISISNDTTLAPEYLPTMSSTDMYHNTTFDWAFLSKKECSKYGGNLVGNNCNFVPDITLMSFILFLGTYTSSMALKKFKTSPYFPTTARKLISDFAIILSILIFCVIDALVGVDTPKLIVPSEFKPTSPNRGWFVPPFGENPWWVCLAAAIPALLVTILIFMDQQITAVIVNRKEHKLKKGAGYHLDLFWVAILMVICSLMALPWYVAATVISIAHIDSLKMETETSAPGEQPKFLGVREQRVTGTLVFILTGLSVFMAPILKFIPMPVLYGVFLYMGVASLNGVQFMDRLKLLLMPLKHQPDFIYLRHVPLRRVHLFTFLQVLCLALLWILKSTVAAIIFPVMILALVAVRKGMDYLFSQHDLSFLDDVIPEKDKKKKEDEKKKKKKKGSLDSDNDDSDCPYSEKVPSIKIPMDIMEQQPFLSDSKPSDRERSPTFLERHTSC

SEQ ID NO: 51 - protein, 1094 aa, Homo sapiens
MEDEAVLDRGASFLKHVCDEEEVEGHHTIYIGVHVPKSYRRRRRHKRKTGHKEKKEKERISENYSDKSDIENADESSSSILKPLISPAAERIRFILGEEDDSPAPPQLFTELDELLAVDGQEMEWKETARWIKFEEKVEQGGERWSKPHVATLSLHSLFELRTCMEKGSIMLDREASSLPQLVEMIVDHQIETGLLKPELKDKVTYTLLRKHRHQTKKSNLRSLADIGKTVSSASRMFTNPDNGSPAMTHRNLTSSSLNDISDKPEKDQLKNKFMKKLPRDAEASNVLVGEVDFLDTPFIAFVRLQQAVMLGALTEVPVPTRFLFILLGPKGKAKSYHEIGRAIATLMSDEVFHDIAYKAKDRHDLIAGIDEFLDEVIVLPPGEWDPAIRIEPPKSLPSSDKRKNMYSGGENVQMNGDTPHDGGHGGGGHGDCEELQRTGRFCGGLIKDIKRKAPFFASDFYDALNIQALSAILFIYLATVTNAITFGGLLGDATDNMQGVLESFLGTAVSGAIFCLFAGQPLTILSSTGPVLVFERLLFNFSKDNNFDYLEFRLWIGLWSAFLCLILVATDASFLVQYFTRFTEEGFSSLISFIFIYDAFKKMIKLADYYPINSNFKVGYNTLFSCTCVPPDPANISISNDTTLAPEYLPTMSSTDMYHNTTFDWAFLSKKECSKYGGNLVGNNCNFVPDITLMSFILFLGTYTSSMALKKFKTSPYFPTTARKLISDFAIILSILIFCVIDALVGVDTPKLIVPSEFKPTSPNRGWFVPPFGENPWWVCLAAAIPALLVTILIFMDQQITAVIVNRKEHKLKKGAGYHLDLFWVAILMVICSLMALPWYVAATVISIAHIDSLKMETETSAPGEQPKFLGVREQRVTGTLVFILTGLSVFMAPILKFIPMPVLYGVFLYMGVASLNGVQFMDRLKLLLMPLKHQPDFIYLRHVPLRRVHLFTFLQVLCLALLWILKSTVAAIIFPVMILALVAVRKGMDYLFSQHDLSFLDDVIPEKDKKKKEDEKKKKKKKGSLDSDNDDEKDHQHSLNATHHADKIPFLQSLGMPSPPRTPVKVVPQIRIELEPEDNDYFWRSKGTETTL

SEQ ID NO: 52 - protein, 1035 aa, Homo sapiens
MSTENVEGKPSNLGERGRARSSTFLRVVQPMFNHSIFTSAVSPAAERIRFILGEEDDSPAPPQLFTELDELLAVDGQEMEWKETARWIKFEEKVEQGGERWSKPHVATLSLHSLFELRTCMEKGSIMLDREASSLPQLVEMIVDHQIETGLLKPELKDKVTYTLLRKHRHQTKKSNLRSLADIGKTVSSASRMFTNPDNGSPAMTHRNLTSSSLNDISDKPEKDQLKNKFMKKLPRDAEASNVLVGEVDFLDTPFIAFVRLQQAVMLGALTEVPVPTRFLFILLGPKGKAKSYHEIGRAIATLMSDEVFHDIAYKAKDRHDLIAGIDEFLDEVIVLPPGEWDPAIRIEPPKSLPSSDKRKNMYSGGENVQMNGDTPHDGGHGGGGHGDCEELQRTGRFCGGLIKDIKRKAPFFASDFYDALNIQALSAILFIYLATVTNAITFGGLLGDATDNMQGVLESFLGTAVSGAIFCLFAGQPLTILSSTGPVLVFERLLFNFSKDNNFDYLEFRLWIGLWSAFLCLILVATDASFLVQYFTRFTEEGFSSLISFIFIYDAFKKMIKLADYYPINSNFKVGYNTLFSCTCVPPDPANISISNDTTLAPEYLPTMSSTDMYHNTTFDWAFLSKKECSKYGGNLVGNNCNFVPDITLMSFILFLGTYTSSMALKKFKTSPYFPTTARKLISDFAIILSILIFCVIDALVGVDTPKLIVPSEFKPTSPNRGWFVPPFGENPWWVCLAAAIPALLVTILIFMDQQITAVIVNRKEHKLKKGAGYHLDLFWVAILMVICSLMALPWYVAATVISIAHIDSLKMETETSAPGEQPKFLGVREQRVTGTLVFILTGLSVFMAPILKFIPMPVLYGVFLYMGVASLNGVQFMDRLKLLLMPLKHQPDFIYLRHVPLRRVHLFTFLQVLCLALLWILKSTVAAIIFPVMILALVAVRKGMDYLFSQHDLSFLDDVIPEKDKKKKEDEKKKKKKKGSLDSDNDDSDCPYSEKVPSIKIPMDIMEQQPFLSDSKPSDRERSPTFLERHTSC

SEQ ID NO: 53 - protein, 365 aa, Homo sapiens
MALLLCFVLLCGVVDFARSLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLVKPSGARCYVDGSEEIGSDFKIKCEPKEGSLPLQYEWQKLSDSQKMPTSWLAEMTSSVISVKNASSEYSGTYSCTVRNRVGSDQCLLRLNVVPPSNKAGLIAGAIIGTLLALALIGLIIFCCRKKRREEKYEKEVHHDIREDVPPPKSRTSTARSYIGSNHSSLGSMSPSNMEGYSKTQYNQVPSEDFERTPQSPTLPPAKVAAPNLSRMGAIPVMIPAQSKDGSIV

SEQ ID NO: 54 - protein, 252 aa, Homo sapiens
MALLLCFVLLCGVVDFARSLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLVKPSGARCYVDGSEEIGSDFKIKCEPKEGSLPLQYEWQKLSDSQKMPTSWLAGKMCHLQRAVRPLPEATSAVIIHPWGPCLLPTWKDIPRLSITKYQVKTLNALLRVRLSHLLR

SEQ ID NO: 55 - protein, 200 aa, Homo sapiens
MALLLCFVLLCGVVDFARSLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLGKMCHLQRAVRPLPEATSAVIIHPWGPCLLPTWKDIPRLSITKYQVKTLNALLRVRLSHLLR

SEQ ID NO: 56 - protein, 89 aa, Homo sapiens
MALLLCFVLLCGVVDFARSLSITTPEEMIEKAKGETAYLPCKFTLSPEDQGPLDIEWLISPADNQKVDQVGRCATSKEPYVHCQKLHRQ

SEQ ID NO: 57 - protein, 352 aa, Homo sapiens
MALLLCFVLLCGVVDFARSLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLVKPSGARCYVDGSEEIGSDFKIKCEPKEGSLPLQYEWQKLSDSQKMPTSWLAEMTSSVISVKNASSEYSGTYSCTVRNRVGSDQCLLRLNVVPPSNKAGLIAGAIIGTLLALALIGLIIFCCRKKRREEKYEKEVHHDIREDVPPPKSRTSTARSYIGSNHSSLGSMSPSNMEGYSKTQYNQVPSEDFERTPQSPTLPPAKFKYPYKTDGITVV

SEQ ID NO: 58 - protein, 388 aa, Homo sapiens
MGRARRFQWPLLLLWAAAAGPGAGQEVQTENVTVAEGGVAEITCRLHQYDGSIVVIQNPARQTLFFNGTRALKDERFQLEEFSPRRVRIRLSDARLEDEGGYFCQLYTEDTHHQIATLTVLVAPENPVVEVREQAVEGGEVELSCLVPRSRPAATLRWYRDRKELKGVSSSQENGKVWSVASTVRFRVDRKDDGGIIICEAQNQALPSGHSKQTQYVLDVQYSPTARIHASQAVVREGDTLVLTCAVTGNPRPNQIRWNRGNESLPERAEAVGETLTLPGLVSADNGTYTCEASNKHGHARALYVLVVYDPGAVVEAQTSVPYAIVGGILALLVFLIICVLVGMVWCSVRQKGSYLTHEASGLDEQGEAREAFLNGSDGHKRKEEFFI

SEQ ID NO: 59 - protein, 943 aa, Homo sapiens
MTQRSIAGPICNLKFVTLLVALSSELPFLGAGVQLQDNGYNGLLIAINPQVPENQNLISNIKEMITEASFYLFNATKRRVFFRNIKILIPATWKANNNSKIKQESYEKANVIVTDWYGAHGDDPYTLQYRGCGKEGKYIHFTPNFLLNDNLTAGYGSRGRVFVHEWAHLRWGVFDEYNNDKPFYINGQNQIKVTRCSSDITGIFVCEKGPCPQENCIISKLFKEGCTFIYNSTQNATASIMFMQSLSSVVEFCNASTHNQEAPNLQNQMCSLRSAWDVITDSADFHHSFPMNGTELPPPPTFSLVQAGDKVVCLVLDVSSKMAEADRLLQLQQAAEFYLMQIVEIHTFVGIASFDSKGEIRAQLHQINSNDDRKLLVSYLPTTVSAKTDISICSGLKKGFEVVEKLNGKAYGSVMILVTSGDDKLLGNCLPTVLSSGSTIHSIALGSSAAPNLEELSRLTGGLKFFVPDISNSNSMIDAFSRISSGTGDIFQQHIQLESTGENVKPHHQLKNTVTVDNTVGNDTMFLVTWQASGPPEIILFDPDGRKYYTNNFITNLTFRTASLWIPGTAKPGHWTYTLNNTHHSLQALKVTVTSRASNSAVPPATVEAFVERDSLHFPHPVMIYANVKQGFYPILNATVTATVEPETGDPVTLRLLDDGAGADVIKNDGIYSRYFFSFAANGRYSLKVHVNHSPSISTPAHSIPGSHAMYVPGYTANGNIQMNAPRKSVGRNEEERKWGFSRVSSGGSFSVLGVPAGPHPDVFPPCKIIDLEAVKVEEELTLSWTAPGEDFDQGQATSYEIRMSKSLQNIQDDFNNAILVNTSKRNPQQAGIREIFTFSPQISTNGPEHQPNGETHESHRIYVAIRAMDRNSLQSAVSNIAQAPLFIPPNSDPVPARDYLILKGVLTAMGLIGIICLIIVVTHHTLSRKKRADKKENGTKLL

SEQ ID NO: 60 - protein, 540 aa, Homo sapiens
MGTTARAALVLTYLAVASAASEGGFTATGQRQLRPEHFQEVGYAAPPSPPLSRSLPMDHPDSSQHGPPFEGQSQVQPPPSQEATPLQQEKLLPAQLPAEKEVGPPLPQEAVPLQKELPSLQHPNEQKEGTPAPFGDQSHPEPESWNAAQHCQQDRSQGGWGHRLDGFPPGRPSPDNLNQICLPNRQHVVYGPWNLPQSSYSHLTRQGETLNFLEIGYSRCCHCRSHTNRLECAKLVWEEAMSRFCEAEFSVKTRPHWCCTRQGEARFSCFQEEAPQPHYQLRACPSHQPDISSGLELPFPPGVPTLDNIKNICHLRRFRSVPRNLPATDPLQRELLALIQLEREFQRCCRQGNNHTCTWKAWEDTLDKYCDREYAVKTHHHLCCRHPPSPTRDECFARRAPYPNYDRDILTIDIGRVTPNLMGHLCGNQRVLTKHKHIPGLIHNMTARCCDLPFPEQACCAEEEKLTFINDLCGPRRNIWRDPALCCYLSPGDEQVNCFNINYLRNVALVSGDTENAKGQGEQGSTGGTNISSTSEPKEE

SEQ ID NO: 61 - protein, 415 aa, Homo sapiens
MGTTARAALVLTYLAVASAASEGGFTATGQRQLRPEHFQEVGYAAPPSPPLSRSLPMDHPDSSQHGPPFEGQSQVQPPPSQEATPLQQEKLLPAQLPAEKEVGPPLPQEAVPLQKELPSLQHPNEQKEGTPAPFGDQSHPEPESWNAAQHCQQDRSQGGWGHRLDGFPPGRPSPDNLNQICLPNRQHVVYGPWNLPQSSYSHLTRQGETLNFLEIGYSRCCHCRSHTNRLECAKLVWEDTLDKYCDREYAVKTHHHLCCRHPPSPTRDECFARRAPYPNYDRDILTIDIGRVTPNLMGHLCGNQRVLTKHKHIPGLIHNMTARCCDLPFPEQACCAEEEKLTFINDLCGPRRNIWRDPALCCYLSPGDEQVNCFNINYLRNVALVSGDTENAKGQGEQGSTGGTNISSTSEPKEE

SEQ ID NO: 62 - protein, 567 aa, Homo sapiens
MGTTARAALVLTYLAVASAASEGGFTATGQRQLRPEHFQEVGYAAPPSPPLSRSLPMDHPDSSQHGPPFEGQSGKEGRGPRPHSQPWLGERVGCSHIPPSIVQPPPSQEATPLQQEKLLPAQLPAEKEVGPPLPQEAVPLQKELPSLQHPNEQKEGTPAPFGDQSHPEPESWNAAQHCQQDRSQGGWGHRLDGFPPGRPSPDNLNQICLPNRQHVVYGPWNLPQSSYSHLTRQGETLNFLEIGYSRCCHCRSHTNRLECAKLVWEEAMSRFCEAEFSVKTRPHWCCTRQGEARFSCFQEEAPQPHYQLRACPSHQPDISSGLELPFPPGVPTLDNIKNICHLRRFRSVPRNLPATDPLQRELLALIQLEREFQRCCRQGNNHTCTWKAWEDTLDKYCDREYAVKTHHHLCCRHPPSPTRDECFARRAPYPNYDRDILTIDIGRVTPNLMGHLCGNQRVLTKHKHIPGLIHNMTARCCDLPFPEQACCAEEEKLTFINDLCGPRRNIWRDPALCCYLSPGDEQVNCFNINYLRNVALVSGDTENAKGQGEQGSTGGTNISSTSEPKEE

SEQ ID NO: 63 - protein, 211 aa, Homo sapiens
MANAGLQLLGFILAFLGWIGAIVSTALPQWRIYSYAGDNIVTAQAMYEGLWMSCVSQSTGQIQCKVFDSLLNLSSTLQATRALMVVGILLGVIAIFVATVGMKCMKCLEDDEVQKMRMAVIGGAIFLLAGLAILVATAWYGNRIVQEFYDPMTPVNARYEFGQALFTGWAAASLCLLGGALLCCSCPRKTTSYPTPRPYPKPAPSSGKDYV

SEQ ID NO: 64 - protein, 248 aa, Homo sapiens [sequence omitted]

SEQ ID NO: 65 - protein, 228 aa, Homo sapiens
MPVKGGTKCIKYLLFGFNFIFWLAGIAVLAIGLWLRFDSQTKSIFEQETNNNNSSFYTGVYILIGAGALMMLVGFLGCCGAVQESQCMLGLFFGFLLVIFAIEIAAAIWGYSHKDEVIKEVQEFYKDTYNKLKTKDEPQRETLKAIHYALNCCGLAGGVEQFISDICPKKDVLETFTVKSCPDAIKEVFDNKFHIIGAVGIGIAVVMIFGMIFSMILCCAIRRNREMV

SEQ ID NO: 66 - protein, 1445 aa, Homo sapiens
MQGPPLLTAAHLLCVCTAALAVAPGPRFLVTAPGIIRPGGNVTIGVELLEHCPSQVTVKAELLKTASNLTVSVLEAEGVFEKGSFKTLTLPSLPLNSADEIYELRVTGRTQDEILFSNSTRLSFETKRISVFIQTDKALYKPKQEVKFRIVTLFSDFKPYKTSLNILIKDPKSNLIQQWLSQQSDLGVISKTFQLSSHPILGDWSIQVQVNDQTYYQSFQVSEYVLPKFEVTLQTPLYCSMNSKHLNGTITAKYTYGKPVKGDVTLTFLPLSFWGKKKNITKTFKINGSANFSFNDEEMKNVMDSSNGLSEYLDLSSPGPVEILTTVTESVTGISRNVSTNVFFKQHDYIIEFFDYTTVLKPSLNFTATVKVTRADGNQLTLEERRNNVVITVTQRNYTEYWSGSNSGNQKMEAVQKINYTVPQSGTFKIEFPILEDSSELQLKAYFLGSKSSMAVHSLFKSPSKTYIQLKTRDENIKVGSPFELVVSGNKRLKELSYMVVSRGQLVAVGKQNSTMFSLTPENSWTPKACVIVYYIEDDGEIISDVLKIPVQLVFKNKIKLYWSKVKAEPSEKVSLRISVTQPDSIVGIVAVDKSVNLMNASNDITMENVVHELELYNTGYYLGMFMNSFAVFQECGLWVLTDANLTKDYIDGVYDNAEYAERFMEENEGHIVDIHDFSLGSSPHVRKHFPETWIWLDTNMGYRIYQEFEVTVPDSITSWVATGFVISEDLGLGLTTTPVELQAFQPFFIFLNLPYSVIRGEEFALEITIFNYLKDATEVKVIIEKSDKFDILMTSNEINATGHQQTLLVPSEDGATVLFPIRPTHLGEIPITVTALSPTASDAVTQMILVKAEGIEKSYSQSILLDLTDNRLQSTLKTLSFSFPPNTVTGSERVQITAIGDVLGPSINGLASLIRMPYGCGEQNMINFAPNIYILDYLTKKKQLTDNLKEKALSFMRQGYQRELLYQREDGSFSAFGNYDPSGSTWLSAFVLRCFLEADPYIDIDQNVLHRTYTWLKGHQKSNGEFWDPGRVIHSELQGGNKSPVTLTAYIVTSLLGYRKYQPNIDVQESIHFLESEFSRGISDNYTLALITYALSSVGSPKAKEALNMLTWRAEQEGGMQFWVSSESKLSDSWQPRSLDIEVAAYALLSHFLQFQTSEGIPIMRWLSRQRNSLGGFASTQDTTVALKALSEFAALMNTERTNIQVTVTGPSSPSPVKFLIDTHNRLLLQTAELAVVQPTAVNISANGFGFAICQLNVVYNVKASGSSRRRRSIQNQEAFDLDVAVKENKDDLNHVDLNVCTSFSGPGRSGMALMEVNLLSGFMVPSEAISLSETVKKVEYDHGKLNLYLDSVNETQFCVNIPAVRNFKVSNTQDASVSIVDYYEPRRQAVRSYNSEVKLSSCDLCSDVQGCRPCEDGASGSHHHSSVIFIFCFKLLYFMELWL

SEQ ID NO: 67 - protein, 1428 aa, Homo sapiens
MQGPPLLTAAHLLCVCTAALAVAPGPRFLVTAPGIIRPGGNVTIGVELLEHCPSQVTVKAELLKTASNLTVSVLEAEGVFEKGSFKTLTLPSLPLNSADEIYELRVTGRTQDEILFSNSTRLSFETKRISVFIQTDKALYKPKQEVKFRIVTLFSDFKPYKTSLNILIKDPKSNLIQQWLSQQSDLGVISKTFQLSSHPILGDWSIQVQVNDQTYYQSFQVSEYVLPKFEVTLQTPLYCSMNSKHLNGTITAKYTYGKPVKGDVTLTFLPLSFWGKKKNITKTFKINGSANFSFNDEEMKNVMDSSNGLSEYLDLSSPGPVEILTTVTESVTGISRNVSTNVFFKQHDYIIEFFDYTTVLKPSLNFTATVKVTRADGNQLTLEERRNNVVITVTQRNYTEYWSGSNSGNQKMEAVQKINYTVPQSGTFKIEFPILEDSSELQLKAYFLGSKSSMAVHSLFKSPSKTYIQLKTRDENIKVGSPFELVVSGNKRLKELSYMVVSRGQLVAVGKQNSTMFSLTPENSWTPKACVIVYYIEDDGEIISDVLKIPVQLVFKNKIKLYWSKVKAEPSEKVSLRISVTQPDSIVGIVAVDKSVNLMNASNDITMENVVHELELYNTGYYLGMFMNSFAVFQECGLWVLTDANLTKDYIDGVYDNAEYAERFMEENEGHIVDIHDFSLGSSPHVRKHFPETWIWLDTNMGYRIYQEFEVTVPDSITSWVATGFVISEDLGLGLTTTPVELQAFQPFFIFLNLPYSVIRGEEFALEITIFNYLKDATEVKVIIEKSDKFDILMTSNEINATGHQQTLLVPSEDGATVLFPIRPTHLGEIPITVTALSPTASDAVTQMILVKAEGIEKSYSQSILLDLTDNRLQSTLKTLSFSFPPNTVTGSERVQITAIGDVLGPSINGLASLIRMPYGCGEQNMINFAPNIYILDYLTKKKQLTDNLKEKALSFMRQGYQRELLYQREDGSFSAFGNYDPSGSTWLSAFVLRCFLEADPYIDIDQNVLHRTYTWLKGHQKSNGEFWDPGRVIHSELQGGNKSPVTLTAYIVTSLLGYRKYQPNIDVQESIHFLESEFSRGISDNYTLALITYALSSVGSPKAKEALNMLTWRAEQEGGMQFWVSSESKLSDSWQPRSLDIEVAAYALLSHFLQFQTSEGIPIMRWLSRQRNSLGGFASTQDTTVALKALSEFAALMNTERTNIQVTVTGPSSPSPLAVVQPTAVNISANGFGFAICQLNVVYNVKASGSSRRRRSIQNQEAFDLDVAVKENKDDLNHVDLNVCTSFSGPGRSGMALMEVNLLSGFMVPSEAISLSETVKKVEYDHGKLNLYLDSVNETQFCVNIPAVRNFKVSNTQDASVSIVDYYEPRRQAVRSYNSEVKLSSCDLCSDVQGCRPCEDGASGSHHHSSVIFIFCFKLLYFMELWL

SEQ ID NO: 68 - protein, 1368 aa, Homo sapiens
MQGPPLLTAAHLLCVCTAALAVAPGPRFLVTAPGIIRPGGNVTIGVELLEHCPSQVTVKAELLKTASNLTVSVLEAEGVFEKGSFKTLTLPSDPKSNLIQQWLSQQSDLGVISKTFQLSSHPILGDWSIQVQVNDQTYYQSFQVSEYVLPKFEVTLQTPLYCSMNSKHLNGTITAKYTYGKPVKGDVTLTFLPLSFWGKKKNITKTFKINGSANFSFNDEEMKNVMDSSNGLSEYLDLSSPGPVEILTTVTESVTGISRNVSTNVFFKQHDYIIEFFDYTTVLKPSLNFTATVKVTRADGNQLTLEERRNNVVITVTQRNYTEYWSGSNSGNQKMEAVQKINYTVPQSGTFKIEFPILEDSSELQLKAYFLGSKSSMAVHSLFKSPSKTYIQLKTRDENIKVGSPFELVVSGNKRLKELSYMVVSRGQLVAVGKQNSTMFSLTPENSWTPKACVIVYYIEDDGEIISDVLKIPVQLVFKNKIKLYWSKVKAEPSEKVSLRISVTQPDSIVGIVAVDKSVNLMNASNDITMENVVHELELYNTGYYLGMFMNSFAVFQECGLWVLTDANLTKDYIDGVYDNAEYAERFMEENEGHIVDIHDFSLGSSPHVRKHFPETWIWLDTNMGYRIYQEFEVTVPDSITSWVATGFVISEDLGLGLTTTPVELQAFQPFFIFLNLPYSVIRGEEFALEITIFNYLKDATEVKVIIEKSDKFDILMTSNEINATGHQQTLLVPSEDGATVLFPIRPTHLGEIPITVTALSPTASDAVTQMILVKAEGIEKSYSQSILLDLTDNRLQSTLKTLSFSFPPNTVTGSERVQITAIGDVLGPSINGLASLIRMPYGCGEQNMINFAPNIYILDYLTKKKQLTDNLKEKALSFMRQGYQRELLYQREDGSFSAFGNYDPSGSTWLSAFVLRCFLEADPYIDIDQNVLHRTYTWLKGHQKSNGEFWDPGRVIHSELQGGNKSPVTLTAYIVTSLLGYRKYQPNIDVQESIHFLESEFSRGISDNYTLALITYALSSVGSPKAKEALNMLTWRAEQEGGMQFWVSSESKLSDSWQPRSLDIEVAAYALLSHFLQFQTSEGIPIMRWLSRQRNSLGGFASTQDTTVALKALSEFAALMNTERTNIQVTVTGPSSPSPVKFLIDTHNRLLLQTAELAVVQPTAVNISANGFGFAICQLNVVYNVKASGSSRRRRSIQNQEAFDLDVAVKENKDDLNHVDLNVCTSFSGPGRSGMALMEVNLLSGFMVPSEAISLSETVKKVEYDHGKLNLYLDSVNETQFCVNIPAVRNFKVSNTQDASVSIVDYYEPRRQAVRSYNSEVKLSSCDLCSDVQGCRPCEDGASGSHHHSSVIFIFCFKLLYFMELWL

SEQ ID NO: 69 - protein, 769 aa, Homo sapiens
MCGSALAFFTAAFVCLQNDRRGPASFLWAAWVFSLVLGLGQGEDNRCASSNAASCARCLALGPECGWCVQEDFISGGSRSERCDIVSNLISKGCSVDSIEYPSVHVIIPTENEINTQVTPGEVSIQLRPGAEANFMLKVHPLKKYPVDLYYLVDVSASMHNNIEKLNSVGNDLSRKMAFFSRDFRLGFGSYVDKTVSPYISIHPERIHNQCSDYNLDCMPPHGYIHVLSLTENITEFEKAVHRQKISGNIDTPEGGFDAMLQAAVCESHIGWRKEAKRLLLVMTDQTSHLALDSKLAGIVVPNDGNCHLKNNVYVKSTTMEHPSLGQLSEKLIDNNINVIFAVQGKQFHWYKDLLPLLPGTIAGEIESKAANLNNLVVEAYQKLISEVKVQVENQVQGIYFNITAICPDGSRKPGMEGCRNVTSNDEVLFNVTVTMKKCDVTGGKNYAIIKPIGFNETAKIHIHRNCSCQCEDNRGPKGKCVDETFLDSKCFQCDENKCHFDEDQFSSESCKSHKDQPVCSGRGVCVCGKCSCHKIKLGKVYGKYCEKDDFSCPYHHGNLCAGHGECEAGRCQCFSGWEGDRCQCPSAAAQHCVNSKGQVCSGRGTCVCGRCECTDPRSIGRFCEHCPTCYTACKENWNCMQCLHPHNLSQAILDQCKTSCALMEQQHYVDQTSECFSSPSYLRIFFIIFIVTFLIGLLKVLIIRQVILQWNSNKIKSSSDYRVSASKKDKLILQSVCTRAVTYRREKPEEIKMDISKLNAHETFRCNF

SEQ ID NO: 70 - protein, 167 aa, Homo sapiens
MLVLLAFIIAFHITSAALLFIATVDNAWWVGDEFFADVWRICTNNTNCTVINDSFQEYSTLQAVQATMILSTILCCIAFFIFVLQLFRLKQGERFVLTSIIQLMSCLCVMIAASIYTDRREDIHDKNAKFYPVTREGSYGYSYILAWVAFACTFISGMMYLILRKRK

SEQ ID NO: 71 - protein, 234 aa, Homo sapiens [sequence omitted]

SEQ ID NO: 72 - protein, 829 aa, Homo sapiens
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKRDWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVLPGTSVMQVTATDEDDAIYTYNGVVAYSIHSQEPKDPHDLMFTIHRSTGTISVISSGLDREKVPEYTLTIQATDMDGDGSTTTAVAVVEILDANDNAPMFDPQKYEAHVPENAVGHEVQRLTVTDLDAPNSPAWRATYLIMGGDDGDHFTITTHPESNQGILTTRKGLDFEAKNQHTLYVEVTNEAPFVLKLPTSTATIVVHVEDVNEAPVFVPPSKVVEVQEGIPTGEPVCVYTAEDPDKENQKISYRILRDPAGWLAMDPDSGQVTAVGTLDREDEQFVRNNIYEVMVLAMDNGSPPTTGTGTLLLTLIDVNDHGPVPEPRQITICNQSPVRQVLNITDKDLSPHTSPFQAQLTDDSDIYWTAEVNEEGDTVVLSLKKFLKQDTYDVHLSLSDHGNKEQLTVIRATVCDCHGHVETCPGPWKGGFILPVLGAVLALLFLLLVLLLLVRKKRKIKEPLLLPEDDTRDNVFYYGEEGGGEEDQDYDITQLHRGLEARPEVVLRNDVAPTIIPTPMYRPRPANPDEIGNFIIENLKAANTDPTAPPYDTLLVFDYEGSGSDAASLSSLTSSASDQDQDYDYLNEWGSRFKKLADMYGGGEDD

SEQ ID NO: 73 - protein, 1822 aa, Homo sapiens
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTGCGWKFEPLLGEELDLRRVTWRLPPELIPRLSASSGRSSDAEAPHGPPDDGGAGGKGGSLPRSATPGPPGEHLVNGRMDFAFPGSTNSLHRMTTTSAAAYGTHLSPHVPHRVLSTSSTLTRDYNSLTRSEHSHSTTLPRDYSTLTSVSSHDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGLTLGAQHLEAGGSLTRHVTQEFVSRTLTTSGTLSTHMDQQFFQT

SEQ ID NO: 74 - protein, 1805 aa, Homo sapiens
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTEHLVNGRMDFAFPGSTNSLHRMTTTSAAAYGTHLSPHVPHRVLSTSSTLTRDYNSLTRSEHSHSTTLPRDYSTLTSVSSHGLPPIWEHGRSRLPLSWALGSRSRAQMKGFPPSRGPRDSIILAGRPAAPSWGPDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGLTLGAQHLEAGGSLTRHVTQEFVSRTLTTSGTLSTHMDQQFFQT

SEQ ID NO: 75 - protein, 1752 aa, Homo sapiens
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTEHLVNGRMDFAFPGSTNSLHRMTTTSAAAYGTHLSPHVPHRVLSTSSTLTRDYNSLTRSEHSHSTTLPRDYSTLTSVSSHDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGLTLGAQHLEAGGSLTRHVTQEFVSRTLTTSGTLSTHMDQQFFQT

SEQ ID NO: 76 - protein, 1172 aa, Homo sapiens [sequence omitted]

SEQ ID NO: 77 - protein, 381 aa, Homo sapiens
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGHTCFTLTGLLGTLVTMGLLT

SEQ ID NO: 78 - protein, 305 aa, Homo sapiens
MTSRTPLLVTACLYYSYCNSRHLQQGVRKSKRPVFSHCQVPETQKTDTRHLSGARAGVCPCCHPDGLLATMRDLLQYIACFFAFFSAGFLIVATWTDCWMVNADDSLEVSTKCRGLWWECVTNAFDGIRTCDEYDSILAEHPLKLVVTRALMITADILAGFGFLTLLLGLDCVKFLPDEPYIKVRICFVAGATLLIAGTPGIIGSVWYAVDVYVERSTLVLHNIFLGIQYKFGWSCWLGMAGSLGCFLAGAVLTCCLYLFKDVGPERNYPYSLRKAYSAAGVSMAKSYSAPRTETAKMYAVDTRV

SEQ ID NO: 79 - protein, 3333 aa, Homo sapiens
MAAAARPRGRALGPVLPPTPLLLLVLRVLPACGATARDPGAAAGLSLHPTYFNLAEAARIWATATCGERGPGEGRPQPELYCKLVGGPTAPGSGHTIQGQFCDYCNSEDPRKAHPVTNAIDGSERWWQSPPLSSGTQYNRVNLTLDLGQLFHVAYILIKFANSPRPDLWVLERSVDFGSTYSPWQYFAHSKVDCLKEFGREANMAVTRDDDVLCVTEYSRIVPLENGEVVVSLINGRPGAKNFTFSHTLREFTKATNIRLRFLRTNTLLGHLISKAQRDPTVTRRYYYSIKDISIGGQCVCNGHAEVCNINNPEKLFRCECQHHTCGETCDRCCTGYNQRRWRPAAWEQSHECEACNCHGHASNCYYDPDVERQQASLNTQGIYAGGGVCINCQHNTAGVNCEQCAKGYYRPYGVPVDAPDGCIPCSCDPEHADGCEQGSGRCHCKPNFHGDNCEKCAIGYYNFPFCLRIPIFPVSTPSSEDPVAGDIKGCDCNLEGVLPEICDAHGRCLCRPGVEGPRCDTCRSGFYSFPICQACWCSALGSYQMPCSSVTGQCECRPGVTGQRCDRCLSGAYDFPHCQGSSSACDPAGTINSNLGYCQCKLHVEGPTCSRCKLLYWNLDKENPSGCSECKCHKAGTVSGTGECRQGDGDCHCKSHVGGDSCDTCEDGYFALEKSNYFGCQGCQCDIGGALSSMCSGPSGVCQCREHVVGKVCQRPENNYYFPDLHHMKYEIEDGSTPNGRDLRFGFDPLAFPEFSWRGYAQMTSVQNDVRITLNVGKSSGSLFRVILRYVNPGTEAVSGHITIYPSWGAAQSKEIIFLPSKEPAFVTVPGNGFADPFSITPGIWVACIKAEGVLLDYLVLLPRDYYEASVLQLPVTEPCAYAGPPQENCLLYQHLPVTRFPCTLACEARHFLLDGEPRPVAVRQPTPAHPVMVDLSGREVELHLRLRIPQVGHYVVVVEYSTEAAQLFVVDVNVKSSGSVLAGQVNIYSCNYSVLCRSAVIDHMSRIAMYELLADADIQLKGHMARFLLHQVCIIPIEEFSAEYVRPQVHCIASYGRFVNQSATCVSLAHETPPTALILDVLSGRPFPHLPQQSSPSVDVLPGVTLKAPQNQVTLRGRVPHLGRYVFVIHFYQAAHPTFPAQVSVDGGWPRAGSFHASFCPHVLGCRDQVIAEGQIEFDISEPEVAATVKVPEGKSLVLVRVLVVPAENYDYQILHKKSMDKSLEFITNCGKNSFYLDPQTASRFCKNSARSLVAFYHKGALPCECHPTGATGPHCSPEGGQCPCQPNVIGRQCTRCATGHYGFPRCKPCSCGRRLCEEMTGQCRCPPRTVRPQCEVCETHSFSFHPMAGCEGCNCSRRGTIEAAMPECDRDSGQCRCKPRITGRQCDRCASGFYRFPECVPCNCNRDGTEPGVCDPGTGACLCKENVEGTECNVCREGSFHLDPANLKGCTSCFCFGVNNQCHSSHKRRTKFVDMLGWHLETADRVDIPVSFNPGSNSMVADLQELPATIHSASWVAPTSYLGDKVSSYGGYLTYQAKSFGLPGDMVLLEKKPDVQLTGQHMSIIYEETNTPRPDRLHHGRVHVVEGNFRHASSRAPVSREELMTVLSRLADVRIQGLYFTETQRLTLSEVGLEEASDTGSGRIALAVEICACPPAYAGDSCQGCSPGYYRDHKGLYTGRCVPCNCNGHSNQCQDGSGICVNCQHNTAGEHCERCQEGYYGNAVHGSCRACPCPHTNSFATGCVVNGGDVRCSCKAGYTGTQCERCAPGYFGNPQKFGGSCQPCSCNSNGQLGSCHPLTGDCINQEPKDSSPAEECDDCDSCVMTLLNDLATMGEQLRLVKSQLQGLSASAGLLEQMRHMETQAKDLRNQLLNYRSAISNHGSKIEGLERELTDLNQEFETLQEKAQVNSRKAQTLNNNVNRATQSAKELDVKIKNVIRNVHILLKQISGTDGEGNNVPSGDFSREWAEAQRMMRELRNRNFGKHLREAEADKRESQLLLNRIRTWQKTHQGENNGLANSIRDSLNEYEAKLSDLRARLQEAAAQAKQANGLNQENERALGAIQRQVKEINSLQSDFTKYLTTADSSLLQTNIALQLMEKSQKEYEKLAASLNEARQELSDKVRELSRSAGKTSLVEEAEKHARSLQELAKQLEEIKRNASGDELVRCAVDAATAYENILNAIKAAEDAANRAASASESALQTVIKEDLPRKAKTLSSNSDKLLNEAKMTQKKLKQEVSPALNNLQQTLNIVTVQKEVIDTNLTTLRDGLHGIQRGDIDAMISSAKSMVRKANDITDEVLDGLNPIQTDVERIKDTYGRTQNEDFKKALTDADNSVNKLTNKLPDLWRKIESINQQLLPLGNISDNMDRIRELIQQARDAASKVAVPMRFNGKSGVEVRLPNDLEDLKGYTSLSLFLQRPNSRENGGTENMFVMYLGNKDASRDYIGMAVVDGQLTCVYNLGDREAELQVDQILTKSETKEAVMDRVKFQRIYQFARLNYTKGATSSKPETPGVYDMDGRNSNTLLNLDPENVVFYVGGYPPDFKLPSRLSFPPYKGCIELDDLNENVLSLYNFKKTFNLNTTEVEPCRRRKEESDKNYFEGTGYARVPTQPHAPIPTFGQTIQTTVDRGLLFFAENGDRFISLNIEDGKLMVRYKLNSELPKERGVGDAINNGRDHSIQIKIGKLQKRMWINVDVQNTIIDGEVFDFSTYYLGGIPIAIRERFNISTPAFRGCMKNLKKTSGVVRLNDTVGVTKKCSEDWKLVRSASFSRGGQLSFTDLGLPPTDHLQASFGFQTFQPSGILLDHQTWTRNLQVTLEDGYIELSTSDSGSPIFKSPQTYMDGLLHYVSVISDNSGLRLLIDDQLLRNSKRLKHISSSRQSLRLGGSNFEGCISNVFVQRLSLSPEVLDLTSNSLKRDVSLGGCSLNKPPFLMLLKGSTRFNKTKTFRINQLLQDTPVASPRSVKVWQDACSPLPKTQANHGALQFGDIPTSHLLFKLPQELLKPRSQFAVDMQTTSSRGLVFHTGTKNSFMALYLSKGRLVFALGTDGKKLRIKSKEKCNDGKWHTVVFGHDGEKGRLVVDGLRAREGSLPGNSTISIRAPVYLGSPPSGKPKSLPTNSFVGCLKNFQLDSKPLYTPSSSFGVSSCLGGPLEKGIYFSEEGGHVVLAHSVLLGPEFKLVFSIRPRSLTGILIHIGSQPGKHLCVYLEAGKVTASMDSGAGGTSTSVTPKQSLCDGQWHSVAVTIKQHILHLELDTDSSYTAGQIPFPPASTQEPLHLGGAPANLTTLRIPVWKSFFGCLRNIHVNHIPVPVTEALEVQGPVSLNGCPDQ

SEQ ID NO: 80 - protein, 3277 aa, Homo sapiens
MAAAARPRGRALGPVLPPTPLLLLVLRVLPACGATARDPGAAAGLSLHPTYFNLAEAARIWATATCGERGPGEGRPQPELYCKLVGGPTAPGSGHTIQGQFCDYCNSEDPRKAHPVTNAIDGSERWWQSPPLSSGTQYNRVNLTLDLGQLFHVAYILIKFANSPRPDLWVLERSVDFGSTYSPWQYFAHSKVDCLKEFGREANMAVTRDDDVLCVTEYSRIVPLENGEVVVSLINGRPGAKNFTFSHTLREFTKATNIRLRFLRTNTLLGHLISKAQRDPTVTRRYYYSIKDISIGGQCVCNGHAEVCNINNPEKLFRCECQHHTCGETCDRCCTGYNQRRWRPAAWEQSHECEACNCHGHASNCYYDPDVERQQASLNTQGIYAGGGVCINCQHNTAGVNCEQCAKGYYRPYGVPVDAPDGCIPCSCDPEHADGCEQGSGRCHCKPNFHGDNCEKCAIGYYNFPFCLRIPIFPVSTPSSEDPVAGDIKGCDCNLEGVLPEICDAHGRCLCRPGVEGPRCDTCRSGFYSFPICQACWCSALGSYQMPCSSVTGQCECRPGVTGQRCDRCLSGAYDFPHCQGSSSACDPAGTINSNLGYCQCKLHVEGPTCSRCKLLYWNLDKENPSGCSECKCHKAGTVSGTGECRQGDGDCHCKSHVGGDSCDTCEDGYFALEKSNYFGCQGCQCDIGGALSSMCSGPSGVCQCREHVVGKVCQRPENNYYFPDLHHMKYEIEDGSTPNGRDLRFGFDPLAFPEFSWRGYAQMTSVQNDVRITLNVGKSSGSLFRVILRYVNPGTEAVSGHITIYPSWGAAQSKEIIFLPSKEPAFVTVPGNGFADPFSITPGIWVACIKAEGVLLDYLVLLPRDYYEASVLQLPVTEPCAYAGPPQENCLLYQHLPVTRFPCTLACEARHFLLDGEPRPVAVRQPTPAHPVMVDLSGREVELHLRLRIPQVGHYVVVVEYSTEAAQLFVVDVNVKSSGSVLAGQVNIYSCNYSVLCRSAVIDHMSRIAMYELLADADIQLKGHMARFLLHQVCIIPIEEFSAEYVRPQVHCIASYGRFVNQSATCVSLAHETPPTALILDVLSGRPFPHLPQQSSPSVDVLPGVTLKAPQNQVTLRGRVPHLGRYVFVIHFYQAAHPTFPAQVSVDGGWPRAGSFHASFCPHVLGCRDQVIAEGQIEFDISEPEVAATVKVPEGKSLVLVRVLVVPAENYDYQILHKKSMDKSLEFITNCGKNSFYLDPQTASRFCKNSARSLVAFYHKGALPCECHPTGATGPHCSPEGGQCPCQPNVIGRQCTRCATGHYGFPRCKPCSCGRRLCEEMTGQCRCPPRTVRPQCEVCETHSFSFHPMAGCEGCNCSRRGTIEAAMPECDRDSGQCRCKPRITGRQCDRCASGFYRFPECVPCNCNRDGTEPGVCDPGTGACLCKENVEGTECNVCREGSFHLDPANLKGCTSCFCFGVNNQCHSSHKRRTKFVDMLGWHLETADRVDIPVSFNPGSNSMVADLQELPATIHSASWVAPTSYLGDKVSSYGGYLTYQAKSFGLPGDMVLLEKKPDVQLTGQHMSIIYEETNTPRPDRLHHGRVHVVEGNFRHASSRAPVSREELMTVLSRLADVRIQGLYFTETQRLTLSEVGLEEASDTGSGRIALAVEICACPPAYAGDSCQGCSPGYYRDHKGLYTGRCVPCNCNGHSNQCQDGSGICVNCQHNTAGEHCERCQEGYYGNAVHGSCRACPCPHTNSFATGCVVNGGDVRCSCKAGYTGTQCERCAPGYFGNPQKFGGSCQPCSCNSNGQLGSCHPLTGDCINQEPKDSSPAEECDDCDSCVMTLLNDLATMGEQLRLVKSQLQGLSASAGLLEQMRHMETQAKDLRNQLLNYRSAISNHGSKIEGLERELTDLNQEFETLQEKAQVNSRKAQTLNNNVNRATQSAKELDVKIKNVIRNVHMLNRIRTWQKTHQGENNGLANSIRDSLNEYEAKLSDLRARLQEAAAQAKQANGLNQENERALGAIQRQVKEINSLQSDFTKYLTTADSSLLQTNIALQLMEKSQKEYEKLAASLNEARQELSDKVRELSRSAGKTSLVEEAEKHARSLQELAKQLEEIKRNASGDELVRCAVDAATAYENILNAIKAAEDAANRAASASESALQTVIKEDLPRKAKTLSSNSDKLLNEAKMTQKKLKQEVSPALNNLQQTLNIVTVQKEVIDTNLTTLRDGLHGIQRGDIDAMISSAKSMVRKANDITDEVLDGLNPIQTDVERIKDTYGRTQNEDFKKALTDADNSVNKLTNKLPDLWRKIESINQQLLPLGNISDNMDRIRELIQQARDAASKVAVPMRFNGKSGVEVRLPNDLEDLKGYTSLSLFLQRPNSRENGGTENMFVMYLGNKDASRDYIGMAVVDGQLTCVYNLGDREAELQVDQILTKSETKEAVMDRVKFQRIYQFARLNYTKGATSSKPETPGVYDMDGRNSNTLLNLDPENVVFYVGGYPPDFKLPSRLSFPPYKGCIELDDLNENVLSLYNFKKTFNLNTTEVEPCRRRKEESDKNYFEGTGYARVPTQPHAPIPTFGQTIQTTVDRGLLFFAENGDRFISLNIEDGKLMVRYKLNSELPKERGVGDAINNGRDHSIQIKIGKLQKRMWINVDVQNTIIDGEVFDFSTYYLGGIPIAIRERFNISTPAFRGCMKNLKKTSGVVRLNDTVGVTKKCSEDWKLVRSASFSRGGQLSFTDLGLPPTDHLQASFGFQTFQPSGILLDHQTWTRNLQVTLEDGYIELSTSDSGSPIFKSPQTYMDGLLHYVSVISDNSGLRLLIDDQLLRNSKRLKHISSSRQSLRLGGSNFEGCISNVFVQRLSLSPEVLDLTSNSLKRDVSLGGCSLNKPPFLMLLKGSTRFNKTKTFRINQLLQDTPVASPRSVKVWQDACSPLPKTQANHGALQFGDIPTSHLLFKLPQELLKPRSQFAVDMQTTSSRGLVFHTGTKNSFMALYLSKGRLVFALGTDGKKLRIKSKEKCNDGKWHTVVFGHDGEKGRLVVDGLRAREGSLPGNSTISIRAPVYLGSPPSGKPKSLPTNSFVGCLKNFQLDSKPLYTPSSSFGVSSCLGGPLEKGIYFSEEGGHVVLAHSVLLGPEFKLVFSIRPRSLTGILIHIGSQPGKHLCVYLEAGKVTASMDSGAGGTSTSVTPKQSLCDGQWHSVAVTIKQHILHLELDTDSSYTAGQIPFPPASTQEPLHLGGAPANLTTLRIPVWKSFFGCLRNIHVNHIPVPVTEALEVQGPVSLNGCPDQ

SEQ ID NO: 81 - protein, 1724 aa, Homo sapiens
MPPAVRRSACSMGWLWIFGAALGQCLGYSSQQQRVPFLQPPGQSQLQASYVEFRPSQGCSPGYYRDHKGLYTGRCVPCNCNGHSNQCQDGSGICVNCQHNTAGEHCERCQEGYYGNAVHGSCRACPCPHTNSFATGCVVNGGDVRCSCKAGYTGTQCERCAPGYFGNPQKFGGSCQPCSCNSNGQLGSCHPLTGDCINQEPKDSSPAEECDDCDSCVMTLLNDLATMGEQLRLVKSQLQGLSASAGLLEQMRHMETQAKDLRNQLLNYRSAISNHGSKIEGLERELTDLNQEFETLQEKAQVNSRKAQTLNNNVNRATQSAKELDVKIKNVIRNVHILLKQISGTDGEGNNVPSGDFSREWAEAQRMMRELRNRNFGKHLREAEADKRESQLLLNRIRTWQKTHQGENNGLANSIRDSLNEYEAKLSDLRARLQEAAAQAKQANGLNQENERALGAIQRQVKEINSLQSDFTKYLTTADSSLLQTNIALQLMEKSQKEYEKLAASLNEARQELSDKVRELSRSAGKTSLVEEAEKHARSLQELAKQLEEIKRNASGDELVRCAVDAATAYENILNAIKAAEDAANRAASASESALQTVIKEDLPRKAKTLSSNSDKLLNEAKMTQKKLKQEVSPALNNLQQTLNIVTVQKEVIDTNLTTLRDGLHGIQRGDIDAMISSAKSMVRKANDITDEVLDGLNPIQTDVERIKDTYGRTQNEDFKKALTDADNSVNKLTNKLPDLWRKIESINQQLLPLGNISDNMDRIRELIQQARDAASKVAVPMRFNGKSGVEVRLPNDLEDLKGYTSLSLFLQRPNSRENGGTENMFVMYLGNKDASRDYIGMAVVDGQLTCVYNLGDREAELQVDQILTKSETKEAVMDRVKFQRIYQFARLNYTKGATSSKPETPGVYDMDGRNSNTLLNLDPENVVFYVGGYPPDFKLPSRLSFPPYKGCIELDDLNENVLSLYNFKKTFNLNTTEVEPCRRRKEESDKNYFEGTGYARVPTQPHAPIPTFGQTIQTTVDRGLLFFAENGDRFISLNIEDGKLMVRYKLNSELPKERGVGDAINNGRDHSIQIKIGKLQKRMWINVDVQNTIIDGEVFDFSTYYLGGIPIAIRERFNISTPAFRGCMKNLKKTSGVVRLNDTVGVTKKCSEDWKLVRSASFSRGGQLSFTDLGLPPTDHLQASFGFQTFQPSGILLDHQTWTRNLQVTLEDGYIELSTSDSGSPIFKSPQTYMDGLLHYVSVISDNSGLRLLIDDQLLRNSKRLKHISSSRQSLRLGGSNFEGCISNVFVQRLSLSPEVLDLTSNSLKRDVSLGGCSLNKPPFLMLLKGSTRFNKTKTFRINQLLQDTPVASPRSVKVWQDACSPLPKTQANHGALQFGDIPTSHLLFKLPQELLKPRSQFAVDMQTTSSRGLVFHTGTKNSFMALYLSKGRLVFALGTDGKKLRIKSKEKCNDGKWHTVVFGHDGEKGRLVVDGLRAREGSLPGNSTISIRAPVYLGSPPSGKPKSLPTNSFVGCLKNFQLDSKPLYTPSSSFGVSSCLGGPLEKGIYFSEEGGHVVLAHSVLLGPEFKLVFSIRPRSLTGILIHIGSQPGKHLCVYLEAGKVTASMDSGAGGTSTSVTPKQSLCDGQWHSVAVTIKQHILHLELDTDSSYTAGQIPFPPASTQEPLHLGGAPANLTTLRIPVWKSFFGCLRNIHVNHIPVPVTEALEVQGPVSLNGCPDQ

SEQ ID NO: 82 - protein, 1668 aa, Homo sapiens
MPPAVRRSACSMGWLWIFGAALGQCLGYSSQQQRVPFLQPPGQSQLQASYVEFRPSQGCSPGYYRDHKGLYTGRCVPCNCNGHSNQCQDGSGICVNCQHNTAGEHCERCQEGYYGNAVHGSCRACPCPHTNSFATGCVVNGGDVRCSCKAGYTGTQCERCAPGYFGNPQKFGGSCQPCSCNSNGQLGSCHPLTGDCINQEPKDSSPAEECDDCDSCVMTLLNDLATMGEQLRLVKSQLQGLSASAGLLEQMRHMETQAKDLRNQLLNYRSAISNHGSKIEGLERELTDLNQEFETLQEKAQVNSRKAQTLNNNVNRATQSAKELDVKIKNVIRNVHMLNRIRTWQKTHQGENNGLANSIRDSLNEYEAKLSDLRARLQEAAAQAKQANGLNQENERALGAIQRQVKEINSLQSDFTKYLTTADSSLLQTNIALQLMEKSQKEYEKLAASLNEARQELSDKVRELSRSAGKTSLVEEAEKHARSLQELAKQLEEIKRNASGDELVRCAVDAATAYENILNAIKAAEDAANRAASASESALQTVIKEDLPRKAKTLSSNSDKLLNEAKMTQKKLKQEVSPALNNLQQTLNIVTVQKEVIDTNLTTLRDGLHGIQRGDIDAMISSAKSMVRKANDITDEVLDGLNPIQTDVERIKDTYGRTQNEDFKKALTDADNSVNKLTNKLPDLWRKIESINQQLLPLGNISDNMDRIRELIQQARDAASKVAVPMRFNGKSGVEVRLPNDLEDLKGYTSLSLFLQRPNSRENGGTENMFVMYLGNKDASRDYIGMAVVDGQLTCVYNLGDREAELQVDQILTKSETKEAVMDRVKFQRIYQFARLNYTKGATSSKPETPGVYDMDGRNSNTLLNLDPENVVFYVGGYPPDFKLPSRLSFPPYKGCIELDDLNENVLSLYNFKKTFNLNTTEVEPCRRRKEESDKNYFEGTGYARVPTQPHAPIPTFGQTIQTTVDRGLLFFAENGDRFISLNIEDGKLMVRYKLNSELPKERGVGDAINNGRDHSIQIKIGKLQKRMWINVDVQNTIIDGEVFDFSTYYLGGIPIAIRERFNISTPAFRGCMKNLKKTSGVVRLNDTVGVTKKCSEDWKLVRSASFSRGGQLSFTDLGLPPTDHLQASFGFQTFQPSGILLDHQTWTRNLQVTLEDGYIELSTSDSGSPIFKSPQTYMDGLLHYVSVISDNSGLRLLIDDQLLRNSKRLKHISSSRQSLRLGGSNFEGCISNVFVQRLSLSPEVLDLTSNSLKRDVSLGGCSLNKPPFLMLLKGSTRFNKTKTFRINQLLQDTPVASPRSVKVWQDACSPLPKTQANHGALQFGDIPTSHLLFKLPQELLKPRSQFAVDMQTTSSRGLVFHTGTKNSFMALYLSKGRLVFALGTDGKKLRIKSKEKCNDGKWHTVVFGHDGEKGRLVVDGLRAREGSLPGNSTISIRAPVYLGSPPSGKPKSLPTNSFVGCLKNFQLDSKPLYTPSSSFGVSSCLGGPLEKGIYFSEEGGHVVLAHSVLLGPEFKLVFSIRPRSLTGILIHIGSQPGKHLCVYLEAGKVTASMDSGAGGTSTSVTPKQSLCDGQWHSVAVTIKQHILHLELDTDSSYTAGQIPFPPASTQEPLHLGGAPANLTTLRIPVWKSFFGCLRNIHVNHIPVPVTEALEVQGPVSLNGCPDQ

SEQ ID NO: 83 - protein, 277 aa, Homo sapiens
MVRLPLQCVLWGCLLTAVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIATGVSDTICEPCPVGFFSNVSSAFEKCHPWTSCETKDLVVQQAGTNKTDVVCGPQDRLRALVVIPIIFGILFAILLVLVFIKKVAKKPTNKAPHPKQEPQEINFPDDLPGSNTAAPVQETLHGCQPVTQEDGKESRISVQERQ

SEQ ID NO: 84 - protein, 203 aa, Homo sapiens
MVRLPLQCVLWGCLLTAVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIATGVSDTICEPCPVGFFSNVSSAFEKCHPWTRSPGSAESPGGDPHHLRDPVCHPLGAGLYQKGGQEANQ

SEQ ID NO: 85 - protein, 1497 aa, Homo sapiens
MDVTKKNKRDGTEVTERIVTETVTTRLTSLPPKGGTSNGYAKTASLGGGSRLEKQSLTHGSSGYINSTGSTRGHASTSSYRRAHSPASTLPNSPGSTFERKTHVTRHAYEGSSSGNSSPEYPRKEFASSSTRGRSQTRESEIRVRLQSASPSTRWTELDDVKRLLKGSRSASVSPTRNSSNTLPIPKKGTVETKIVTASSQSVSGTYDATILDANLPSHVWSSTLPAGSSMGTYHNNMTTQSSSLLNTNAYSAGSVFGVPNNMASCSPTLHPGLSTSSSVFGMQNNLAPSLTTLSHGTTTTSTAYGVKKNMPQSPAAVNTGVSTSAACTTSVQSDDLLHKDCKFLILEKDNTPAKKEMELLIMTKDSGKVFTASPASIAATSFSEDTLKKEKQAAYNADSGLKAEANGDLKTVSTKGKTTTADIHSYGSSGGGGSGGGGGVGGAGGGPWGPAPAWCPCGSCCSWWKWLLGLLLTWLLLLGLLFGLIALAEEVRKLKARVDELERIRRSILPYGDSMDRIEKDRLQGMAPAAGADLDKIGLHSDSQEELWMFVRKKLMMEQENGNLRGSPGPKGDMGSPGPKGDRGFPGTPGIPGPLGHPGPQGPKGQKGSVGDPGMEGPMGQRGREGPMGPRGEAGPPGSGEKGERGAAGEPGPHGPPGVPGSVGPKGSSGSPGPQGPPGPVGLQGLRGEVGLPGVKGDKGPMGPPGPKGDQGEKGPRGLTGEPGMRGLPGAVGEPGAKGAMGPAGPDGHQGPRGEQGLTGMPGIRGPPGPSGDPGKPGLTGPQGPQGLPGTPGRPGIKGEPGAPGKIVTSEGSSMLTVPGPPGPPGAMGPPGPPGAPGPAGPAGLPGHQEVLNLQGPPGPPGPRGPPGPSIPGPPGPRGPPGEGLPGPPGPPGSFLSNSETFLSGPPGPPGPPGPKGDQGPPGPRGHQGEQGLPGFSTSGSSSFGLNLQGPPGPPGPQGPKGDKGDPGVPGALGIPSGPSEGGSSSTMYVSGPPGPPGPPGPPGSISSSGQEIQQYISEYMQSDSIRSYLSGVQGPPGPPGPPGPVTTITGETFDYSELASHVVSYLRTSGYGVSLFSSSISSEDILAVLQRDDVRQYLRQYLMGPRGPPGPPGASGDGSLLSLDYAELSSRILSYMSSSGISIGLPGPPGPPGLPGTSYEELLSLLRGSEFRGIVGPPGPPGPPGIPGNVWSSISVEDLSSYLHTAGLSFIPGPPGPPGPPGPRGPPGVSGALATYAAENSDSFRSELISYLTSPDVRSFIVGPPGPPGPQGPPGDSRLLSTDASHSRGSSSSSHSSSVRRGSSYSSSMSTGGGGAGSLGAGGAFGEAAGDRGPYGTDIGPGGGYGAAAEGGMYAGNGGLLGADFAGDLDYNELAVRVSESMQRQGLLQGMAYTVQGPPGQPGPQGPPGISKVFSAYSNVTADLMDFFQTYGAIQGPPGQKGEMGTPGPKGDRGPAGPPGHPGPPGPRGHKGEKGDKGDQVYAGRRRRRSIAVKP

SEQ ID NO: 86 - protein, 901 aa, Homo sapiens
MEAARPSGSWNGALCRLLLLTLAILIFASDACKNVTLHVPSKLDAEKLVGRVNLKECFTAANLIHSSDPDFQILEDGSVYTTNTILLSSEKRSFTILLSNTENQEKKKIFVFLEHQTKVLKKRHTKEKVLRRAKRRWAPIPCSMLENSLGPFPLFLQQVQSDTAQNYTIYYSIRGPGVDQEPRNLFYVERDTGNLYCTRPVDREQYESFEIIAFATTPDGYTPELPLPLIIKIEDENDNYPIFTEETYTFTIFENCRVGTTVGQVCATDKDEPDTMHTRLKYSIIGQVPPSPTLFSMHPTTGVITTTSSQLDRELIDKYQLKIKVQDMDGQYFGLQTTSTCIINIDDVNDHLPTFTRTSYVTSVEENTVDVEILRVTVEDKDLVNTANWRANYTILKGNENGNFKIVTDAKTNEGVLCVVKPLNYEEKQQMILQIGVVNEAPFSREASPRSAMSTATVTVNVEDQDEGPECNPPIQTVRMKENAEVGTTSNGYKAYDPETRSSSGIRYKKLTDPTGWVTIDENTGSIKVFRSLDREAETIKNGIYNITVLASDQGGRTCTGTLGIILQDVNDNSPFIPKKTVIICKPTMSSAEIVAVDPDEPIHGPPFDFSLESSTSEVQRMWRLKAINDTAARLSYQNDPPFGSYVVPITVRDRLGMSSVTSLDVTLCDCITENDCTHRVDPRIGGGGVQLGKWAILAILLGIALLFCILFTLVCGASGTSKQPKVIPDDLAQQNLIVSNTEAPGDDKVYSANGFTTQTVGASAQGVCGTVGSGIKNGGQETIEMVKGGHQTSESCRGAGHHHTLDSCRGGHTEVDNCRYTYSEWHSFTQPRLGEKVYLCNQDENHKHAQDYVLTYNYEGRGSVAGSVGCCSERQEEDGLEFLDNLEPKFRTLAEACMKR

SEQ ID NO: 87 - protein, 847 aa, Homo sapiens
MEAARPSGSWNGALCRLLLLTLAILIFASDACKNVTLHVPSKLDAEKLVGRVNLKECFTAANLIHSSDPDFQILEDGSVYTTNTILLSSEKRSFTILLSNTENQEKKKIFVFLEHQTKVLKKRHTKEKVLRRAKRRWAPIPCSMLENSLGPFPLFLQQVQSDTAQNYTIYYSIRGPGVDQEPRNLFYVERDTGNLYCTRPVDREQYESFEIIAFATTPDGYTPELPLPLIIKIEDENDNYPIFTEETYTFTIFENCRVGTTVGQVCATDKDEPDTMHTRLKYSIIGQVPPSPTLFSMHPTTGVITTTSSQLDRELIDKYQLKIKVQDMDGQYFGLQTTSTCIINIDDVNDHLPTFTRTSYVTSVEENTVDVEILRVTVEDKDLVNTANWRANYTILKGNENGNFKIVTDAKTNEGVLCVVKPLNYEEKQQMILQIGVVNEAPFSREASPRSAMSTATVTVNVEDQDEGPECNPPIQTVRMKENAEVGTTSNGYKAYDPETRSSSGIRYKKLTDPTGWVTIDENTGSIKVFRSLDREAETIKNGIYNITVLASDQGGRTCTGTLGIILQDVNDNSPFIPKKTVIICKPTMSSAEIVAVDPDEPIHGPPFDFSLESSTSEVQRMWRLKAINDTAARLSYQNDPPFGSYVVPITVRDRLGMSSVTSLDVTLCDCITENDCTHRVDPRIGGGGVQLGKWAILAILLGIALLFCILFTLVCGASGTSKQPKVIPDDLAQQNLIVSNTEAPGDDKVYSANGFTTQTVGASAQGVCGTVGSGIKNGGQETIEMVKGGHQTSESCRGAGHHHTLDSCRGGHTEVDNCRYTYSEWHSFTQPRLGEESIRGHTLIKN

SEQ ID NO: 88 - protein, 894 aa, Homo sapiens
MALASAAPGSIFCKQLLFSLLVLTLLCDACQKVYLRVPSHLQAETLVGKVNLEECLKSASLIRSSDPAFRILEDGSIYTTHDLILSSERKSFSIFLSDGQRREQQEIKVVLSARENKSPKKRHTKDTALKRSKRRWAPIPASLMENSLGPFPQHVQQIQSDAAQNYTIFYSISGPGVDKEPFNLFYIEKDTGDIFCTRSIDREKYEQFALYGYATTADGYAPEYPLPLIIKIEDDNDNAPYFEHRVTIFTVPENCRSGTSVGKVTATDLDEPDTLHTRLKYKILQQIPDHPKHFSIHPDTGVITTTTPFLDREKCDTYQLIMEVRDMGGQPFGLFNTGTITISLEDENDNPPSFTETSYVTEVEENRIDVEILRMKVQDQDLPNTPHSKAVYKILQGNENGNFIISTDPNTNEGVLCVVKPLNYEVNRQVILQVGVINEAQFSKAASSQTPTMCTTTVTVKIIDSDEGPECHPPVKVIQSQDGFPAGQELLGYKALDPEISSGEGLRYQKLGDEDNWFEINQHTGDLRTLKVLDRESKFVKNNQYNISVVAVDAVGRSCTGTLVVHLDDYNDHAPQIDKEVTICQNNEDFAVLKPVDPDGPENGPPFQFFLDNSASKNWNIEEKDGKTAILRQRQNLDYNYYSVPIQIKDRHGLVATHMLTVRVCDCSTPSECRMKDKSTRDVRPNVILGRWAILAMVLGSVLLLCILFTCFCVTAKRTVKKCFPEDIAQQNLIVSNTEGPGEEVTEANIRLPMQTSNICDTSMSVGTVGGQGIKTQQSFEMVKGGYTLDSNKGGGHQTLESVKGVGQGDTGRYAYTDWQSFTQPRLGEKVYLCGQDEEHKHCEDYVCSYNYEGKGSLAGSVGCCSDRQEEEGLEFLDHLEPKFRTLAKTCIKK

SEQ ID NO: 89 - protein, 840 aa, Homo sapiens
MALASAAPGSIFCKQLLFSLLVLTLLCDACQKVYLRVPSHLQAETLVGKVNLEECLKSASLIRSSDPAFRILEDGSIYTTHDLILSSERKSFSIFLSDGQRREQQEIKVVLSARENKSPKKRHTKDTALKRSKRRWAPIPASLMENSLGPFPQHVQQIQSDAAQNYTIFYSISGPGVDKEPFNLFYIEKDTGDIFCTRSIDREKYEQFALYGYATTADGYAPEYPLPLIIKIEDDNDNAPYFEHRVTIFTVPENCRSGTSVGKVTATDLDEPDTLHTRLKYKILQQIPDHPKHFSIHPDTGVITTTTPFLDREKCDTYQLIMEVRDMGGQPFGLFNTGTITISLEDENDNPPSFTETSYVTEVEENRIDVEILRMKVQDQDLPNTPHSKAVYKILQGNENGNFIISTDPNTNEGVLCVVKPLNYEVNRQVILQVGVINEAQFSKAASSQTPTMCTTTVTVKIIDSDEGPECHPPVKVIQSQDGFPAGQELLGYKALDPEISSGEGLRYQKLGDEDNWFEINQHTGDLRTLKVLDRESKFVKNNQYNISVVAVDAVGRSCTGTLVVHLDDYNDHAPQIDKEVTICQNNEDFAVLKPVDPDGPENGPPFQFFLDNSASKNWNIEEKDGKTAILRQRQNLDYNYYSVPIQIKDRHGLVATHMLTVRVCDCSTPSECRMKDKSTRDVRPNVILGRWAILAMVLGSVLLLCILFTCFCVTAKRTVKKCFPEDIAQQNLIVSNTEGPGEEVTEANIRLPMQTSNICDTSMSVGTVGGQGIKTQQSFEMVKGGYTLDSNKGGGHQTLESVKGVGQGDTGRYAYTDWQSFTQPRLGEESIRGHTLIKN

SEQ ID NO: 90 - protein, 1073 aa, Homo sapiens
MAAAGQLCLLYLSAGLLSRLGAAFNLDTREDNVIRKYGDPGSLFGFSLAMHWQLQPEDKRLLLVGAPRAEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRNKKDHYDATYHKAEIHAQPSDKERLTSDA

SEQ ID NO: 91 - protein, 1091 aa, Homo sapiens
MAAAGQLCLLYLSAGLLSRLGAAFNLDTREDNVIRKYGDPGSLFGFSLAMHWQLQPEDKRLLLVGAPRAEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRSRYDDSVPRYHAVRIRKEEREIKDEKYIDNLEKKQWITKWNENESYS

SEQ ID NO: 92 - protein, 1822 aa, Homo sapiens; identical to SEQ ID NO: 73

SEQ ID NO: 93 - protein, 1805 aa, Homo sapiens; identical to SEQ ID NO: 74

SEQ ID NO: 94 - protein, 1752 aa, Homo sapiens; identical to SEQ ID NO: 75

SEQ ID NO: 95 - protein, 510 aa, Homo sapiens
MPLSLGAEMWGPEAWLLLLLLLASFTGRCPAGELETSDVVTVVLGQDAKLPCFYRGDSGEQVGQVAWARVDAGEGAQELALLHSKYGLHVSPAYEGRVEQPPPPRNPLDGSVLLRNAVQADEGEYECRVSTFPAGSFQARLRLRVLVPPLPSLNPGPALEEGQGLTLAASCTAEGSPAPSVTWDTEVKGTTSSRSFKHSRSAAVTSEFHLVPSRSMNGQPLTCVVSHPGLLQDQRITHILHVSFLAEASVRGLEDQNLWHIGREGAMLKCLSEGQPPPSYNWTRLDGPLPSGVRVDGDTLGFPPLTTEHSGIYVCHVSNEFSSRDSQVTVDVLDPQEDSGKQVDLVSASVVVVGVIAALLFCLLVVVVVLMSRYHRRKAQQMTQKYEEELTLTRENSIRRLHSHHTDPRSQPEESVGLRAEGHPDSLKDNSSCSVMSEEPEGRSYSTLTTVREIETQTELLSPGSGRAEEEEDQDEGIKQAMNHFVQENGTLRAKPTGNGIYINGRGHLV

SEQ ID NO: 96 - protein, 310 aa, Homo sapiens
MRRAALWLWLCALALSLQPALPQIVATNLPPEDQDGSGDDSDNFSGSGAGALQDITLSQQTPSTWKDTQLLTAIPTSPEPTGLEATAASTSTLPAGEGPKEGEAVVLPEVEPGLTAREQEATPRPRETTQLPTTHQASTTTATTAQEPATSHPHRDMQPGHHETSTPAGPSQADLHTPHTEDGGPSATERAAEDGASSQLPAAEGSGEQDFTFETSGENTAVVAVEPDRRNQSPVDQGATGASQGLLDRKEVLGGVIAGGLVGLIFAVCLVGFMLYRMKKKDEGSYSLEEPKQANGGAYQKPTKQEEFYA

SEQ ID NO: 97 - protein, 925 aa, Homo sapiens
MERDGCAGGGSRGGEGGRAPREGPAGNGRDRGRSHAAEAPGDPQAAASLLAPMDVGEEPLEKAARARTAKDPNTYKVLSLVLSVCVLTTILGCIFGLKPSCAKEVKSCKGRCFERTFGNCRCDAACVELGNCCLDYQETCIEPEHIWTCNKFRCGEKRLTRSLCACSDDCKDKGDCCINYSSVCQGEKSWVEEPCESINEPQCPAGFETPPTLLFSLDGFRAEYLHTWGGLLPVISKLKKCGTYTKNMRPVYPTKTFPNHYSIVTGLYPESHGIIDNKMYDPKMNASFSLKSKEKFNPEWYKGEPIWVTAKYQGLKSGTFFWPGSDVEINGIFPDIYKMYNGSVPFEERILAVLQWLQLPKDERPHFYTLYLEEPDSSGHSYGPVSSEVIKALQRVDGMVGMLMDGLKELNLHRCLNLILISDHGMEQGSCKKYIYLNKYLGDVKNIKVIYGPAARLRPSDVPDKYYSFNYEGIARNLSCREPNQHFKPYLKHFLPKRLHFAKSDRIEPLTFYLDPQWQLALNPSERKYCGSGFHGSDNVFSNMQALFVGYGPGFKHGIEADTFENIEVYNLMCDLLNLTPAPNNGTHGSLNHLLKNPVYTPKHPKEVHPLVQCPFTRNPRDNLGCSCNPSILPIEDFQTQFNLTVAEEKIIKHETLPYGRPRVLQKENTICLLSQHQFMSGYSQDILMPLWTSYTVDRNDSFSTEDFSNCLYQDFRIPLSPVHKCSFYKNNTKVSYGFLSPPQLNKNSSGIYSEALLTTNIVPMYQSFQVIWRYFHDTLLRKYAEERNGVNVVSGPVFDFDYDGRCDSLENLRQKRRVIRNQEILIPTHFFIVLTSCKDTSQTPLHCENLDTLAFILPHRTDNSESCVHGKHDSSWVEELLMLHRARITDVEHITGLSFYQQRKEPVSDILKLKTHLPTFSQED

SEQ ID NO: 98 - protein, 328 aa, Homo sapiens
MLVRRGARAGPRMPRGWTALCLLSLLPSGFMSLDNNGTATPELPTQGTFSNVSTNVSYQETTTPSTLGSTSLHPVSQHGNEATTNITETTVKFTSTSVITSVYGNTNSSVQSQTSVISTVFTTPANVSTPETTLKPSLSPGNVSDLSTTSTSLATSPTKPYTSSSPILSDIKAEIKCSGIREVKLTQGICLEQNKTSSCAEFKKDRGEGLARVLCGEEQADADAGAQVCSLLLAQSEVRPQCLLLVLANRTEISSKLQLMKKHQSDLKKLGILDFTEQDVASHQSYSQKTLIALVTSGALLAVLGITGYFLMNRRSWSPTGERLELEP

SEQ ID NO: 99 - protein, 385 aa, Homo sapiens
MLVRRGARAGPRMPRGWTALCLLSLLPSGFMSLDNNGTATPELPTQGTFSNVSTNVSYQETTTPSTLGSTSLHPVSQHGNEATTNITETTVKFTSTSVITSVYGNTNSSVQSQTSVISTVFTTPANVSTPETTLKPSLSPGNVSDLSTTSTSLATSPTKPYTSSSPILSDIKAEIKCSGIREVKLTQGICLEQNKTSSCAEFKKDRGEGLARVLCGEEQADADAGAQVCSLLLAQSEVRPQCLLLVLANRTEISSKLQLMKKHQSDLKKLGILDFTEQDVASHQSYSQKTLIALVTSGALLAVLGITGYFLMNRRSWSPTGERLGEDPYYTENGGGQGYSSGPGTSPEAQGKASVNRGAQENGTGQATSRNGHSARQHVVADTEL

SEQ ID NO: 100 - protein, 310 aa, Homo sapiens
MALRRPPRLRLCARLPDFFLLLLFRGCLIGAVNLKSSNRTPVVQEFESVELSCIITDSQTSDPRIEWKKIQDEQTTYVFFDNKIQGDLAGRAEILGKTSLKIWNVTRRDSALYRCEVVARNDRKEIDEIVIELTVQVKPVTPVCRVPKAVPVGKMATLHCQESEGHPRPHYSWYRNDVPLPTDSRANPRFRNSSFHLNSETGTLVFTAVHKDDSGQYYCIASNDAGSARCEEQEMEVYDLNIGGIIGGVLVVLAVLALITLGICCAYRRGYFINNKQDGESYKNPGKPDGVNYIRTDEEGDFRHKSSFVI

SEQ ID NO: 101 - protein, 259 aa, Homo sapiens
MALRRPPRLRLCARLPDFFLLLLFRGCLIGAVNLKSSNRTPVVQEFESVELSCIITDSQTSDPRIEWKKIQDEQTTYVFFDNKIQVKPVTPVCRVPKAVPVGKMATLHCQESEGHPRPHYSWYRNDVPLPTDSRANPRFRNSSFHLNSETGTLVFTAVHKDDSGQYYCIASNDAGSARCEEQEMEVYDLNIGGIIGGVLVVLAVLALITLGICCAYRRGYFINNKQDGESYKNPGKPDGVNYIRTDEEGDFRHKSSFVI

SEQ ID NO: 102 - protein, 375 aa, Homo sapiens
MERASCLLLLLLPLVHVSATTPEPCELDDEDFRCVCNFSEPQPDWSEAFQCVSAVEVEIHAGGLNLEPFLKRVDADADPRQYADTVKALRVRRLTVGAAQVPAQLLVGALRVLAYSRLKELTLEDLKITGTMPPLPLEATGLALSSLRLRNVSWATGRSWLAELQQWLKPGLKVLSIAQAHSPAFSCEQVRAFPALTSLDLSDNPGLGERGLMAALCPHKFPAIQNLALRNTGMETPTGVCAALAAAGVQPHSLDLSHNSLRATVNPSAPRCMWSSALNSLNLSFAGLEQVPKGLPAKLRVLDLSCNRLNRAPQPDELPEVDNLTLDGNPFLVPGTALPHEGSMNSGVVPACARSTLSVGVSGTLVLLQGARGFA

SEQ ID NO: 103 - protein, 329 aa, Homo sapiens
MSGVVPTAPEQPAGEMENQTKPPDPRPDAPPEYNSHFLPGPPGTAVPPPTGYPGGLPMGYYSPQQPSTFPLYQPVGGIHPVRYQPGKYPMPNQSVPITWMPGPTPMANCPPGLEYLVQLDNIHVLQHFEPLEMMTCFETNNRYDIKNNSDQMVYIVTEDTDDFTRNAYRTLRPFVLRVTDCMGREIMTMQRPFRCTCCCFCCPSARQELEVQCPPGVTIGFVAEHWNLCRAVYSIQNEKKENVMRVRGPCSTYGCGSDSVFEVKSLDGISNIGSIIRKWNGLLSAMADADHFDIHFPLDLDVKMKAMIFGACFLIDFMYFERSPPQRSR

SEQ ID NO: 104 - protein, 239 aa, Homo sapiens
MSGVVPTAPEQPAGEMENQTKPPDPRPDAPPEYNSHFLPGPPGTAVPPPTGYPGGLPMGYYSPQQPSTFPLYQPVGGIHPVRYQPGKYPMPNQSVPITWMPGPTPMANCPPGLEYLVQLEVQCPPGVTIGFVAEHWNLCRAVYSIQNEKKENVMRVRGPCSTYGCGSDSVFEVKSLDGISNIGSIIRKWNGLLSAMADADHFDIHFPLDLDVKMKAMIFGACFLIDFMYFERSPPQRSR

SEQ ID NO: 105 - protein, 224 aa, Homo sapiens
MENQTKPPDPRPDAPPEYNSHFLPGPPGTAVPPPTGYPGGLPMGYYSPQQPSTFPLYQPVGGIHPVRYQPGKYPMPNQSVPITWMPGPTPMANCPPGLEYLVQLEVQCPPGVTIGFVAEHWNLCRAVYSIQNEKKENVMRVRGPCSTYGCGSDSVFEVKSLDGISNIGSIIRKWNGLLSAMADADHFDIHFPLDLDVKMKAMIFGACFLIDFMYFERSPPQRSR

SEQ ID NO: 106 - protein, 675 aa, Homo sapiens
MPRAQPSSASYQPVPADPFAIVSRAQQMVEILSDENRNLRQELEGCYEKVARLQKVETEIQRVSEAYENLVKSSSKREALEKAMRNKLEGEIRRMHDFNRDLRERLETANKQLAEKEYEGSEDTRKTISQLFAKNKESQREKEKLEAELATARSTNEDQRRHIEIRDQALSNAQAKVVKLEEELKKKQVYVDKVEKMQQALVQLQAACEKREQLEHRLRTRLERELESLRIQQRQGNCQPTNVSEYNAAALMELLREKEERILALEADMTKWEQKYLEENVMRHFALDAAATVAAQRDTTVISHSPNTSYDTALEARIQKEEEEILMANKRCLDMEGRIKTLHAQIIEKDAMIKVLQQRSRKEPSKTEQLSCMRPAKSLMSISNAGSGLLSHSSTLTGSPIMEEKRDDKSWKGSLGILLGGDYRAEYVPSTPSPVPPSTPLLSAHSKTGSRDCSTQTERGTESNKTAAVAPISVPAPVAAAATAAAITATAATITTTMVAAAPVAVAAAAAPAAAAAPSPATAAATAAAVSPAAAGQIPAAASVASAAAVAPSAAAAAAVQVAPAAPAPVPAPALVPVPAPAAAQASAPAQTQAPTSAPAVAPTPAPTPTPAVAQAEVPASPATGPGPHRLSIPSLTCNPDKTDGPVFHSNTLERKTPIQILGQEPDAEMVEYLI

SEQ ID NO: 107 - protein, 1084 aa, Homo sapiens
MRNSEEQPSGGTTVLQRLLQEQLRYGNPSENRSLLAIHQQATGNGPPFPSGSGNPGPQSDVLSPQDHHQQLVAHAARQEPQGQEIQSENLIMEKQLSPRMQNNEELPTYEEAKVQSQYFRGQQHASVGAAFYVTGVTNQKMRTEGRPSVQRLNPGKMHQDEGLRDLKQGHVRSLSERLMQMSLATSGVKAHPPVTSAPLSPPQPNDLYKNPTSSSEFYKAQGPLPNQHSLKGMEHRGPPPEYPFKGMPPQSVVCKPQEPGHFYSEHRLNQPGRTEGQLMRYQHPPEYGAARPAQDISLPLSARNSQPHSPTSSLTSGGSLPLLQSPPSTRLSPARHPLVPNQGDHSAHLPRPQQHFLPNQAHQGDHYRLSQPGLSQQQQQQQQQHHHHHHHQQQQQQQPQQQPGEAYSAMPRAQPSSASYQPVPADPFAIVSRAQQMVEILSDENRNLRQELEGCYEKVARLQKVETEIQRVSEAYENLVKSSSKREALEKAMRNKLEGEIRRMHDFNRDLRERLETANKQLAEKEYEGSEDTRKTISQLFAKNKESQREKEKLEAELATARSTNEDQRRHIEIRDQALSNAQAKVVKLEEELKKKQVYVDKVEKMQQALVQLQAACEKREQLEHRLRTRLERELESLRIQQRQGNCQPTNVSEYNAAALMELLREKEERILALEADMTKWEQKYLEENVMRHFALDAAATVAAQRDTTVISHSPNTSYDTALEARIQKEEEEILMANKRCLDMEGRIKTLHAQIIEKDAMIKVLQQRSRKEPSKTEQLSCMRPAKSLMSISNAGSGLLSHSSTLTGSPIMEEKRDDKSWKGSLGILLGGDYRAEYVPSTPSPVPPSTPLLSAHSKTGSRDCSTQTERGTESNKTAAVAPISVPAPVAAAATAAAITATAATITTTMVAAAPVAVAAAAAPAAAAAPSPATAAATAAAVSPAAAGQIPAAASVASAAAVAPSAAAAAAVQVAPAAPAPVPAPALVPVPAPAAAQASAPAQTQAPTSAPAVAPTPAPTPTPAVAQAEVPASPATGPGPHRLSIPSLTCNPDKTDGPVFHSNTLERKTPIQILGQEPDAEMVEYLI

SEQ ID NO: 108 - protein, 957 aa, Homo sapiens
MNFAEREGSKRYCIQTKHVAILCAVVVGVGLIVGLAVGLTRSCDSSGDGGPGTAPAPSHLPSSTASPSGPPAQDQDICPASEDESGQWKNFRLPDFVNPVHYDLHVKPLLEEDTYTGTVSISINLSAPTRYLWLHLRETRITRLPELKRPSGDQVQVRRCFEYKKQEYVVVEAEEELTPSSGDGLYLLTMEFAGWLNGSLVGFYRTTYTENGQVKSIVATDHEPTDARKSFPCFDEPNKKATYTISITHPKEYGALSNMPVAKEESVDDKWTRTTFEKSVPMSTYLVCFAVHQFDSVKRISNSGKPLTIYVQPEQKHTAEYAANITKSVFDYFEEYFAMNYSLPKLDKIAIPDFGTGAMENWGLITYRETNLLYDPKESASSNQQRVATVVAHELVHQWFGNIVTMDWWEDLWLNEGFASFFEFLGVNHAETDWQMRDQMLLEDVLPVQEDDSLMSSHPIIVTVTTPDEITSVFDGISYSKGSSILRMLEDWIKPENFQKGCQMYLEKYQFKNAKTSDFWAALEEASRLPVKEVMDTWTRQMGYPVLNVNGVKNITQKRFLLDPRANPSQPPSDLGYTWNIPVKWTEDNITSSVLFNRSEKEGITLNSSNPSGNAFLKINPDHIGFYRVNYEVATWDSIATALSLNHKTFSSADRASLIDDAFALARAQLLDYKVALNLTKYLKREENFLPWQRVISAVTYIISMFEDDKELYPMIEEYFQGQVKPIADSLGWNDAGDHVTKLLRSSVLGFACKMGDREALNNASSLFEQWLNGTVSLPVNLRLLVYRYGMQNSGNEISWNYTLEQYQKTSLAQEKEKLLYGLASVKNVTLLSRYLDLLKDTNLIKTQDVFTVIRYISYNSYGKNMAWNWIQLNWDYLVNRYTLNNRNLGRIVTIAEPFNTELQLWQMESFFAKYPQAGAGEKPREQVLETVKNNIEWLKQHRNTIREWFFNLLESG

SEQ ID NO: 109 - protein, 161 aa, Homo sapiens
MNLAISIALLLTVLQVSRGQKVTSLTACLVDQSLRLDCRHENTSSSPIQYEFSLTRETKKHVLFGTVGVPEHTYRSRTNFTSKYNMKVLYLSAFTSKDEGTYTCALHHSGHSPPISSQNVTVLRDKLVKCEGISLLAQNTSWLLLLLLSLSLLQATDFMSL

What is claimed is:

1. A method of forming a composition enriched with human corneal endothelial cells comprising: (a) contacting a cell population containing human corneal cells with a first positive affinity reagent that selectively binds to human corneal endothelial cells relative to human corneal endothelial cells that have undergone a fibroblastic transformation and selecting cells to which the first positive affinity reagent is bound, wherein said first positive affinity reagent comprises an antibody that binds to CD56 surface protein, an antibody that binds to CD166 surface protein, an antibody that binds to coxsackievirus and adenovirus receptor (CAR) surface protein, or an antibody that binds to CD248 surface protein, (b) contacting the cell population containing human corneal cells with a second positive affinity reagent that selectively binds to human corneal endothelial cells relative to human corneal endothelial cells that have undergone a fibroblastic transformation and selecting cells to which the second positive affinity reagent is bound, wherein the second positive affinity reagent differs from the first positive affinity reagent and (c) optionally, contacting said cell population containing human corneal cells with a first negative affinity reagent that selectively binds to human corneal endothelial cells that have undergone a fibroblastic transformation relative to human corneal endothelial cells and removing the cells to which the first negative affinity reagent is bound.

2. The method of claim 1, wherein said first positive affinity reagent comprises an antibody that binds to CD56 surface protein, an antibody that binds to CAR surface protein, or an antibody that binds to CD248 surface protein.

3. The method of claim 1, wherein said second positive affinity reagent comprises an antibody that binds to CD56 surface protein, an antibody that binds to CAR surface protein, or an antibody that binds to CD248 surface protein.

4. The method of claim 1, wherein said cell population containing human corneal cells is contacted with said first negative affinity reagent and wherein cells to which the first negative affinity reagent is bound are removed.

5. The method of claim 4, wherein said first negative affinity reagent comprises an antibody that binds to CD109 surface protein.

6. The method of claim 1, wherein the first positive affinity reagent is coupled to a first label, wherein the second positive affinity reagent is coupled to a second label, and wherein the optional first negative affinity reagent is coupled to a third label, wherein the first label, the second label and the third label may be the same or different.

7. A composition enriched with human corneal endothelial cells that is made by the method of claim 6.

8. A kit comprising
two positive affinity reagents that selectively bind to human corneal endothelial cells relative to human corneal endothelial cells that have undergone a fibroblastic transformation, wherein said two positive affinity reagents comprise (i) a first positive affinity reagent comprising an antibody that binds to CD56 surface protein, an antibody that binds to CD166 surface protein, an antibody that binds to CAR surface protein, or an antibody that binds to CD248 surface protein, and (ii) a second positive affinity reagent that is different from the first positive affinity reagent and comprises an antibody that binds to CD56 surface protein, an antibody that binds to CD166 surface protein, an antibody that binds to CAR surface protein, or an antibody that binds to CD248 surface protein.

9. The kit of claim 8, wherein said first positive affinity reagent comprises an antibody that binds to CD56 surface protein, an antibody that binds to CAR surface protein, or an antibody that binds to CD248 surface protein.

10. The kit of claim 8, further comprising a negative affinity reagent that selectively binds to human corneal endothelial cells that have undergone a fibroblastic transformation relative to human corneal endothelial cells, wherein said negative affinity reagent comprises an antibody that binds a CD109 surface protein.

11. A composition comprising: (a) human corneal cells; (b) a first positive affinity reagent that selectively binds to human corneal endothelial cells relative to human corneal endothelial cells that have undergone a fibroblastic transformation, wherein said positive affinity reagent comprises an antibody that binds to CD56 surface protein, an antibody that binds to CD166 surface protein, an antibody that binds to CAR surface protein, or an antibody that binds to CD248 surface protein, and (c) a second positive affinity reagent that selectively binds to human corneal endothelial cells relative to human corneal endothelial cells that have undergone a fibroblastic transformation and selecting cells to which the second positive affinity reagent is bound, wherein the second positive affinity reagent differs from the first positive affinity reagent.

12. The composition of claim 11, wherein said first positive affinity reagent comprises an antibody that binds to CD56 surface protein, an antibody that binds to CAR surface protein, or an antibody that binds to CD248 surface protein.

13. The composition claim 11, wherein said second positive affinity reagent comprises an antibody that binds to CD56 surface protein, an antibody that binds to CAR surface protein, or an antibody that binds to CD248 surface protein.

14. The composition of claim 11, wherein said composition further comprises a negative affinity reagent that selectively binds to human corneal endothelial cells that have undergone a fibroblastic transformation relative to human corneal endothelial cells, and wherein said negative affinity reagent comprises an antibody that binds to a CD 109 surface protein.

* * * * *